United States Patent 12,570,711 (PLATFORMS FOR CO-STIMULATION, NOVEL CAR DESIGNS AND OTHER ENHANCEMENTS FOR ADOPTIVE CELLULAR THERAPY) - sequence listing, part 5

SEQ ID NO: 6158 - protein, 1100 aa, Artificial Sequence
  Synthetic Polypeptide encoding a CAR with optional accessory module(s)
MALPVTALLLPLALLLHAARPDIVLTQSPAIITASPGEKVTMTCRASSSVNYMDWYQKKPGSSPKPWIYATSNLASGVPSRFSGSGSGTTYSMTISSLEAEDAATYYCQQWSFNPPTFGGGTKLEIKRGGGGSGGGGSGGGGSEVQLQQSGAELKKPGASVKVSCKASGYTFTSYNMHWVKQTPGQGLEWIGAIYPGNGDTSYNQKFKGKTTLTADKSSSTAYMELSSLRSEDTAVYYCARSNYYGSSYWFFDVWGTGTTVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6159 - protein, 1103 aa, Artificial Sequence
  Synthetic Polypeptide encoding a CAR with optional accessory module(s)
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSDWPLTFGGGTKVEIKGGGGSGGGGSGGGGSEVQLVQSGGGLVHPGGSLRLSCTGSGFTFSYHAMHWVRQAPGKGLEWVSIIGTGGVTYYADSVKGRFTISRDNVKNSLYLQMNSLRAEDMAVYYCARDYYGAGSFYDGLYGMDVWGQGTTVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6160 - protein, 1101 aa, Artificial Sequence
  Synthetic Polypeptide encoding a CAR with optional accessory module(s)
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGGGTKVEIKGGGGSGGGGSGGGGSAVQLVESGGGLVQPGRSLRLSCAASGFTFGDYTMHWVRQAPGKGLEWVSGISWNSGSIGYADSVKGRFTISRDNAKNSLYLQMNSLRAEDTALYYCTKDNQYGSGSTYGLGVWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6161 - protein, 1100 aa, Artificial Sequence
  Synthetic Polypeptide encoding a CAR with optional accessory module(s)
MALPVTALLLPLALLLHAARPDIQMTQSPSSLSASVGDRVTITCRASSSVSYMHWYQQKPGKAPKPLIYAPSNLASGVPSRFSGSGSGTDFTLTISSLQPEDFATYYCQQWSFNPPTFGQGTKVEIKRGGGGSGGGGSGGGGSEVQLVESGGGLVQPGGSLRLSCAASGYTFTSYNMHWVRQAPGKGLEWVGAIYPGNGDTSYNQKFKGRFTISVDKSKNTLYLQMNSLRAEDTAVYYCARVVYYSNSYWYFDVWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6162 - protein, 1098 aa, Artificial Sequence
  Synthetic Polypeptide encoding a CAR with optional accessory module(s)
MALPVTALLLPLALLLHAARPDIQLTQSPSSLSASVGDRVTMTCRASSSVSYIHWFQQKPGKAPKPWIYATSNLASGVPVRFSGSGSGTDYTFTISSLQPEDIATYYCQQWTSNPPTFGGGTKLEIKGGGGSGGGGSGGGGSQVQLQQSGAEVKKPGSSVKVSCKASGYTFTSYNMHWVKQAPGQGLEWIGAIYPGNGDTSYNQKFKGKATLTADESTNTAYMELSSLRSEDTAFYYCARSTYYGGDWYFDVWGQGTTVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6163 - protein, 1110 aa, Artificial Sequence
  Synthetic Polypeptide encoding a CAR with optional accessory module(s)
MALPVTALLLPLALLLHAARPSTVMTQSPDSLAVSLGERATINCKSSQSNSNDVAWYQQKPGQSPKVLIYFASNRYSGVPDRFSGSGYGTDFTLTISSLQAEDVAVYFCQQDYSSPLTFGAGTKLELKRADAGGGGSGGGGSGGGGSQIQLVQSGSELKKPGASVKVSCKASGYTFTNFGVNWVRQAPGKGLEWMGWINTYTGEPSYAQGFTGRFVFSLDASVSTAYLQISSLKAEDTATYFCTRRTNYYGTSYYYAMDYWGQGTTVTVSSAKTTTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6164 - protein, 1102 aa, Artificial Sequence
  Synthetic Polypeptide encoding a CAR with optional accessory module(s)
MALPVTALLLPLALLLHAARPQIVLSQSPAILSASPGEKVTMTCRASSSVSYMHWYQQKPGSSPKPWIYATSNLASGVPARFSGSGSGTSYSFTISRVEAEDAATYYCQQWTFNPPTFGGGTRLEIKRTVAAGGGGSGGGGSGGGGSQAYLQQSGAELVRPGASVKMSCKASGYTFTSYNMHWVKQTPRQGLEWIGGIYPGNGDTSYNQKFKGKATLTVGKSSSTAYMQLSSLTSEDSAVYFCARYDYNYAMDYWGQGTSVTVSSASTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6165 - protein, 1100 aa, Artificial Sequence; identical to SEQ ID NO: 6161
  Synthetic Polypeptide encoding a CAR with optional accessory module(s)

SEQ ID NO: 6166 - protein, 1099 aa, Artificial Sequence
  Synthetic Polypeptide encoding a CAR with optional accessory module(s)
MALPVTALLLPLALLLHAARPEIVLTQSPSSLSASVGDRVTITCRASSSLSFMHWYQQKPGKAPKPWIYATSNLASGVPSRFSGSGSGTDYTLTISSLQPEDFATYFCHQWSSNPLTFGGGTKVEIKGGGGSGGGGSGGGGSQVQLVQSGAEVKKPGASVKVSCKASGYTFTSYNMHWVRQAPGQRLEWIGAIYPGNGDTSYNQKFKGRVTVTRDTSANTAYMELSSLKSEDTAVYYCARSHYGSNYVDYFDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6167 - protein, 1101 aa, Artificial Sequence
  Synthetic Polypeptide encoding a CAR with optional accessory module(s)
MALPVTALLLPLALLLHAARPDEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGGGGSGGGGSGGGGSEVQLVESGGGLVQPDRSLRLSCAASGFTFHDYAMHWVRQAPGKGLEWVSTISWNSGTIGYADSVKGRFTISRDNAKNSLYLQMNSLRAEDTALYYCAKDIQYGNYYYGMDVWGQGTTVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6168 - protein, 1099 aa, Artificial Sequence
  Synthetic Polypeptide encoding a CAR with optional accessory module(s)
MALPVTALLLPLALLLHAARPEIVLTQSPGTLSLSPGERATLSCRASSSVPYIHWYQQKPGQAPRLLIYATSALASGIPDRFSGSGSGTDFTLTISRLEPEDFAVYYCQQWLSNPPTFGQGTKLELKRGGGGSGGGGSGGGGSEVQLVQSGAEVKKPGESLKLSCKGSGRTFTSYNMHWVRQMPGKGLEWMGAIYPLTGDTSYNQKSKLQVTISADKSISTAYLQWSSLKASDTAMYYCARSTYVGGDWQFDVWGKGTTVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6169 - protein, 1104 aa, Artificial Sequence
  Synthetic Polypeptide encoding a CAR with optional accessory module(s)
MALPVTALLLPLALLLHAARPDIQMTQSPSSLSASVGDRVTITCRSSQSIVHSVGNTFLEWYQQKPGKAPKLLIYKVSNRFSGVPSRFSGSGSGTDFTLTISSLQPEDFATYYCFQGSQFPYTFGQGTKVEIKRGGGGSGGGGSGGGGSEVQLVESGGGLVQPGGSLRLSCAASGYEFSRSWMNWVRQAPGKGLEWVGRIYPGDGDTNYSGKFKGRFTISADTSKNTAYLQMNSLRAEDTAVYYCARDGSSWDWYFDVWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6170 - protein, 1096 aa, Artificial Sequence
  Synthetic Polypeptide encoding a CAR with optional accessory module(s)
MALPVTALLLPLALLLHAARPDIVMTQSPSSLSASVGDRVTITCKASQSVTNDVAWYQQKPGKAPKLLIYYASNRYTGVPSRFSGSGSGTDFTLTISSLQPEDFATYYCQQDYRSPWTFGGGTKVEIKRGGGGSGGGGSGGGGSQVQLEESGGGVVRPGRSLRLSCAASGFTFSDYGVNWIRQAPGKGLEWVTIIWGDGRTDYNSALKSRFTVSRNNSNNTLSLQMNSLTTEDTAVYYCVRAPGNRAMEYWGQGVLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6171 - protein, 1102 aa, Artificial Sequence
  Synthetic Polypeptide encoding a CAR with optional accessory module(s)
MALPVTALLLPLALLLHAARPDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQIFGQGTKLEIKGGGGSGGGGSGGGGSQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6172 - protein, 1102 aa, Artificial Sequence
  Synthetic Polypeptide encoding a CAR with optional accessory module(s)
MALPVTALLLPLALLLHAARPQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSGGGGSGGGGSGGGGSDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQIFGQGTKLEIKTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6173 - protein, 1095 aa, Artificial Sequence
  Synthetic Polypeptide encoding a CAR with optional accessory module(s)
MALPVTALLLPLALLLHAARPDIQMTQSPATIENTSLSASVGDRVTITCRASQGISSWLTWYQQKPEKAPKSLIYAASSLQSGVPSRFSGSGSGTDFTLTISSLQPEDFATYYCQQYDSYPITFGQGTRLEIKGGGGSGGGGSGGGGSQVQLQQWGAGLLKPSETLSLTCAVYGGSFSAYYWSWIRQPPGKGLEWIGDINHGGGTNYNPSLKSRVTISVDTSKNQFSLKLNSVTAADTAVYYCASLTAYWGQGSLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6174 - protein, 1100 aa, Artificial Sequence
  Synthetic Polypeptide encoding a CAR with optional accessory module(s)
MALPVTALLLPLALLLHAARPDEIVLTQSPDSLAVSLGERATINCKASQSVDFDGDSYLNWYQQKPGQPPKVLIYAASTLQSGVPSRFSGSGSGTDFTLTINSLEAEDAATYYCQQSNEDPWTFGGGTKVEIKGGGGSGGGGSGGGGSQVQLVQSGAEVKKPGASVKVSCKVSGYTFTDYYITWVRQAPGQALEWMGWIYPGSGNTKYSQKFQGRFVFSVDTSASTAYLQLSSLKAEDTAVYYCANYGNYWFAYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6175 - protein, 1097 aa, Artificial Sequence
  Synthetic Polypeptide encoding a CAR with optional accessory module(s)
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKGGGGSGGGGSGGGGSEVQLVQSGGGLVHPGGSLRLSCAGSGFAFSSSTMHWIRQAPGKGLEWISLIGSGGGIYYGDSVKGRFTISRDNAKNSLYLQMNSLRAEDMAVYYCVRGYFDWVDYFDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6176 - protein, 1107 aa, Artificial Sequence
  Synthetic Polypeptide encoding a CAR with optional accessory module(s)
MALPVTALLLPLALLLHAARPDDIVMTQSPDSLTVSLGERTTINCKSSQSVLDSSKNKNSLAWYQQKPGQPPKLLLSWASTRESGIPDRFSGSGSGTDFTLTIDSLQPEDSATYYCQQSAHFPITFGQGTRLEIKGGGGSGGGGSGGGGSQVQLVQSGAEVKKPGASVKVSCKASGYTFTNYGMNWVKQAPGQGLKWMGWINTYTGEPTYADDFKGRVTMTSDTSTSTAYLELHNLRSDDTAVYYCARWSWSDGYYVYFDYWGQGTTVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6177 - protein, 1103 aa, Artificial Sequence
  Synthetic Polypeptide encoding a CAR with optional accessory module(s)
MALPVTALLLPLALLLHAARPDEIVLTQSPGSLAVSPGERVTMSCKSSQSVFFSSSQKNYLAWYQQIPGQSPRLLIYWASTRESGVPDRFTGSGSGTDFTLTISSVQPEDLAIYYCHQYLSSRTFGQGTKLEIKRGGGGSGGGGSGGGGSQVQLQQPGAEVVKPGASVKMSCKASGYTFTSYYIHWIKQTPGQGLEWVGVIYPGNDDISYNQKFQGKATLTADKSSTTAYMQLSSLTSEDSAVYYCAREVRLRYFDVWGQGTTVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6178 - protein, 1129 aa, Artificial Sequence
  Synthetic Polypeptide encoding a CAR with optional accessory module(s)
MALPVTALLLPLALLLHAARPYINIYNAEPANPSEKNSPTQYAYGSGEFDIQLTQSPSSLSASVGDRVTITCRASQGISSVLAWYQQKPGKAPKLLIYDASSLESGVPSRFSGSGSGTDFTLTISSLQPEDFATYYCQQFNSSITFGQGTKLEIKRTVAAGGGGSGGGGSGGGGSQVQLVQSGAEVKKPGSSVKVSCKASGGTFSDYAISWVRQAPGQGLEWMGRIIPILGVANYAQKFQGRVTITADKSTRTAYMELSSLRSEDTAVYYCARNWADAFDIWGQGTMVTVSSASTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6179 - protein, 1128 aa, Artificial Sequence
  Synthetic Polypeptide encoding a CAR with optional accessory module(s)
MALPVTALLLPLALLLHAARPYINIYNAEPANPSEKNSPTQYAYGSGEFDIVMTQSPSSLSASLGGKVTITCKASQDINKYIAWYQHKPGKGPRLLIHYTSTLQPGIPSRFSGSGSGRDYSFSISNLEPEDIATYYCLQYDNLLTFGAGTKLELKRGGGGSGGGGSGGGGSEVKLQQSGPELVKPGTSVKVSCKASGYSFTDYNMYWVKQSHGKSLEWIGYIDPYKGGTIYNQKFKGKATLTVDKSSSTAFMHLNSLTSEDSAVYYCAREMITAYYFDYWGQGSSVTVSSLERTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6180 - protein, 1144 aa, Artificial Sequence
  Synthetic Polypeptide encoding a CAR with optional accessory module(s)
MALPVTALLLPLALLLHAARPDIQMTQSPSSLSASVGDRVTINCKASQDINSYLSWFQQKPGKAPKTLIYRANRLVDGVPSRFSGSGSGQDYTLTISSLQPEDFATYYCLQYDEFPLTFGGGTKVEIKGGGGSGGGGSGGGGSQVQLVQSGAEVKKPGASVKVSCKASGYTFTNYDINWVRQAPGQGLEWIGWIYPGDGSTKYNEKFKAKATLTADTSTSTAYMELRSLRSDDTAVYYCASGYEDAMDYWGQGTTVTVSSAKPTTTPAPRPPTPAPTIASQPLSLRPEACRPAAGGAVHTRGLDFACDITRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6181 - protein, 1100 aa, Artificial Sequence
  Synthetic Polypeptide encoding a CAR with optional accessory module(s)
MALPVTALLLPLALLLHAARPEIVLTQSPLSLPVTPGEPASISCRSSQSLLHSNGYNYLDWYLQKPGQSPQLLIYLGVNSVSGVPDRFSGSGSGTDFTLKISRVEAEDVGVYYCMQALQTPWTFGQGTKVEIKGGGGSGGGGSGGGGSQVQLVQSGAEVKKPGSSVKVSCKASGGIFSNHAISWVRQAPGQGLEWMGGIIPIFGTANYAQKFQGRVTITADESTSTAFMELSSLRSEDTAVYYCAREWADVFDIWGQGTMVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6182 - protein, 1099 aa, Artificial Sequence
  Synthetic Polypeptide encoding a CAR with optional accessory module(s)
MALPVTALLLPLALLLHAARPDIQMTQSPASLTVSLGQRATISCRASESVDSYGNSYLHWYQQKPGQPPQLLIYLASNLESGVPARFSGSGSRTDFTLTIDPVEADDAATYYCQQNNEDPWTFGGGTKVEIKGGGGSGGGGSGGGGSEVQLQQSGAELVKPGASVKMSCKAFGYTFTTFPIEWMKQSHGKSLEWIGNFHPYNDQTKYNEEFKGRAKLTIDRSSSTVYLELGRLTSDDSAVYYCARGYYYAFDFWGQGTTLTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6183 - protein, 1096 aa, Artificial Sequence
  Synthetic Polypeptide encoding a CAR with optional accessory module(s)
MALPVTALLLPLALLLHAARPDIQMTQSPSSLSASVGDRVTITCRASQGIRNDLGWYQQKPGKAPKRLIYAASSLQSGVPSRFSGSGSGTEFTLTISSLQPEDFATYYCLQHNSYPWTFGQGTKLEIKGGGGSGGGGSGGGGSEVQLVESGGALIQPGGSLRLSCVASGFTISGNYMSWVRQAPGKGLEWVSLIYSGDSTYYADSVKGRFTISRDISKNTVYLQMNSLRVEDTAVYYCVRDGYYVSDMVVWGKGTTVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6184 - protein, 1106 aa, Artificial Sequence
  Synthetic Polypeptide encoding a CAR with optional accessory module(s)
MALPVTALLLPLALLLHAARPDVLLTQSPLSLPVTLGQPASISCRSSQTIVHSNGNTYLEWFQQRPGQSPRLLIYQVSNRFSGVPDRFSGSGSGTDFTLKISRVEAEDVGVYYCFQGSHVPRTFGGGTKVEIKRGGGGSGGGGSGGGGSQIQLVQSGSELKKPGASVKVSCKASGYTFTNYGMNWVRQAPGQGLKWMGWINTNTGEPKYAEEFKGRFALSLDTSVSTAYLQINSLKAEDTAVYFCARGYGNYARGAWLAYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6185 - protein, 1093 aa, Artificial Sequence
  Synthetic Polypeptide encoding a CAR with optional accessory module(s)
MALPVTALLLPLALLLHAARPDEIVLTQSPATLSLSPGERATLSCSASSSINYIYWLQQKPGQAPRILIYLTSNLASGVPARFSGSGSGTDFTLTISSLEPEDFAVYYCLQWSSNPLTFGGGTKVEIKGGGGSGGGGSGGGGSFEVQLVESGGGLVKPGGSLRLSCAASGFTFSSYDMSWVRQAPGKGLEWVSTISSGGSYTYYLDSIKGRFTISRDNAKNSLYLQMNSLRAEDTAVYYCARQGLDYWGRGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6186 - protein, 1101 aa, Artificial Sequence
  Synthetic Polypeptide encoding a CAR with optional accessory module(s)
MALPVTALLLPLALLLHAARPDIVMTQSPDSLAVSLGERATINCRASKSVSTSGYSFMHWYQQKPGQPPKLLIYLASNLESGVPDRFSGSGSGTDFTLTISSLQAEDVAVYYCQHSREVPWTFGQGTKVEIKRGGGGSGGGGSGGGGSQVQLVQSGAEVKKPGASVKVSCKASGYTFTNYGMNWVRQAPGQGLEWMGWINTYTGEPTYADAFKGRFAFSLDTSTSTAYLQINSLRSDDTAVYYCARDYGDYGMDYWGQGTTVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6187 - protein, 1097 aa, Artificial Sequence
  Synthetic Polypeptide encoding a CAR with optional accessory module(s)
MALPVTALLLPLALLLHAARPDIVMTQTPLTLSVTIGQPASISCKSSQSLLDSDGKTYLNWLLQRPGQSPERLIYLVSKLDSGVPDRFTGSGSGTDFTLKISRVEAEDLGVYCCWQGTHFPYTFGGGTKVEIKGGGGGSGGGGSGGGGSQVQLQQPGAELVRPGASVKLSCKASGYTFTSYWMNWVKQRPGQGLEWIGMIDPSDSETHYNHIFKDKATLTVDKSSSTAYLQLSSLTSEDSAVYYCARNLYLWGQGTSVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6188 - protein, 1101 aa, Artificial Sequence
  Synthetic Polypeptide encoding a CAR with optional accessory module(s)
MALPVTALLLPLALLLHAARPDDIQLTQSPSSLSASVGDRVTITCKASQSVDYEGDSFLNWYQQKPGKAPKLLIYAASNLESGVPSRFSGSGSGTDFTLTISSLQPEDFATYYCQQSNEDPLTFGQGTKVEIKRGGGGSGGGGSGGGGSEVQLVESGGGLVQPGGSLRLSCAASGYTFSSYWIEWVRQAPGKGLEWIGEILPGGGDTNYNEIFKGRATFSADTSKNTAYLQMNSLRAEDTAVYYCTRRVPIRLDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6189 - protein, 1097 aa, Artificial Sequence
  Synthetic Polypeptide encoding a CAR with optional accessory module(s)
MALPVTALLLPLALLLHAARPDIVMTQTPLSLSVTPGQPASISCKSSQSLLDGDGKTYLNWLLQKPGQSPQRLIYLVSKLDSGVPDRFSGSGSGTDFTLKISRVEAEDVGVYYCWQGTHFPRTFGQGTKLEIKGGGGSGGGGSGGGGSQVQLVQSGAEVKKPGASVKVSCKASGYTFKDTYIHWVRQAPGQGLEWMGRIDPANGNTKYDPKFQGRVTMTRDTSISTAYMELSRLRSDDTAVYYCARRGGVDWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6190 - protein, 1105 aa, Artificial Sequence
  Synthetic Polypeptide encoding a CAR with optional accessory module(s)
MALPVTALLLPLALLLHAARPDIVMTQSPDSLAVSLGERATINCESSQSLLNSGNQKNYLTWYQQKPGQPPKPLIYWASTRESGVPDRFSGSGSGTDFTLTISSLQAEDVAVYYCQNDYSYPYTFGQGTKLEIKRGGGGSGGGGSGGGGSEVQLVQSGAEVKKPGESLKISCKGSGYSFTDYYMKWARQMPGKGLEWMGDIIPSNGATFYNQKFKGQVTISADKSISTTYLQWSSLKASDTAMYYCARSHLLRASWFAYWGQGTMVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6191 - protein, 1100 aa, Artificial Sequence
  Synthetic Polypeptide encoding a CAR with optional accessory module(s)
MALPVTALLLPLALLLHAARPDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKGGGGSGGGGSGGGGSQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6192 - protein, 1104 aa, Artificial Sequence
  Synthetic Polypeptide encoding a CAR with optional accessory module(s)
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKGGGGSGGGGSGGGGSEVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6193 - protein, 1104 aa, Artificial Sequence
  Synthetic Polypeptide encoding a CAR with optional accessory module(s)
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKGGGGSGGGGSGGGGSQVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6194 - protein, 1098 aa, Artificial Sequence
  Synthetic Polypeptide encoding a CAR with optional accessory module(s)
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQDYGFPWTFGQGTKVEIKRGGGGSGGGGSGGGGSEVQLVQSGAEVKKPGESLKISCKGSGYSFTSYWISWVRQMPGKGLEWMGIIDPSDSDTRYSPSFQGQVTISADKSISTAYLQWSSLKASDTAMYYCARGDGSTDLDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6195 - protein, 1100 aa, Artificial Sequence
  Synthetic Polypeptide encoding a CAR with optional accessory module(s)
MALPVTALLLPLALLLHAARPQFVLTQPPSVSTNPGSTVKLSCKRNTGNIGSNYVNWYQQKPGQSPTTMIYRDDKRPDGVPDRFSGSIDRSSNSALLTINNVQTEDEADYFCQSYSSGINIIFGGGTKLTVLGGGGSGGGGSGGGGSQVQLQESGPGLVKPSETLSLTCTVSGFSLTTYDVHWVRQPPGKGLEWMGRIQNAGITDYNSALKSRLIISRDTSKSQVFLKMNSVTTADTAMYFCAKTGSYFYAFDHWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6196 - protein, 1097 aa, Artificial Sequence
  Synthetic Polypeptide encoding a CAR with optional accessory module(s)
MALPVTALLLPLALLLHAARPDIQMTQSPASLSASLGETVTIECRPSEDIHSNVAWYQQKPGNSPQLLIYDASNLADGVPSRFSGSGSGTQYSLKINSLQSEDVASYFCHQYNIYPYTFGSGTKLELKGGGGSGGGGSGGGGSQVQLQESGPTLVKPGDSVKMSCKASGYTFTDYIIHWVKQSHGKSLEWIGYINPYSDGTNYNEKFKSKATLTVDKSTSTAYMEFSRLTSEDSAIYFCALNYGSYYAMDAWGQGTSVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6197 - protein, 1098 aa, Artificial Sequence
  Synthetic Polypeptide encoding a CAR with optional accessory module(s)
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGQGTKVEIKRGGGGSGGGGSGGGGSEVQLLESGGGLVQPGGSLRLSCAASGFTFSGYWMHWVRQAPGKGLEWVSAIRSDGSSKYYADSVKGRFTISRDNSKNTLYLQMNSLRAEDTAVYYCAKDGVIEDTFDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6198 - protein, 1094 aa, Artificial Sequence
  Synthetic Polypeptide encoding a CAR with optional accessory module(s)
MALPVTALLLPLALLLHAARPDVQITQSPSYLAASPGETITINCRASKSISKDLAWYQEKPGKTNKLLIYSGSTLQSGIPSRFSGSGSGTDFTLTISSLEPEDFAMYYCQQHNKYPYTFGGGTKLEIKRGGGGSGGGGSGGGGSQVQLQQPGAELVRPGASVKLSCKASGYTFTSYWMNWVKQRPDQGLEWIGRIDPYDSETHYNQKFKDKAILTVDKSSSTAYMQLSSLTSEDSAVYYCARGNWDDYWGQGTTLTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6199 - protein, 1125 aa, Artificial Sequence
  Synthetic Polypeptide encoding a CAR with optional accessory module(s)
MALPVTALLLPLALLLHAARPYINIYNAEPANPSEKNSPTQYAYGSGEFDIQMTQSPASLSASLGETVTIECRTSKDIYSNLAWFQQEPGNSPQLLIYDASNLADGVPSRFSGSGSGTQYSLQINNLQSEDVASYFCHQYNNYPYTFGTGTKLELKGGGGSGGGGSGGGGSQVQLQESGPTLVNPGDSVKMSCKASGYTFTDHIIHWVKQSHGKSLEWIGYINPYSGGANYNGKFKSKATLTIDKSSSTAYMEFSRLTSGDSAIYYCALNYGSYYAMDAWGQGTSVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6200 - protein, 1096 aa, Artificial Sequence
  Synthetic Polypeptide encoding a CAR with optional accessory module(s)
MALPVTALLLPLALLLHAARPEIVLTQSPTSMTASPGEQVTITCRASSSINYMHWYQQKPGASPRPWIYETSKLASGVPDRFSGSASGTSYSLTINNMEAEDAATYYCQQWNYPSWTFGGGTKLELKGGGGSGGGGSGGGGSEVQLVESGGGLVQPGRSLKLSCAASGFTFSDYNMAWVRQAPKKGLEWVATILYDGGRTYYRGSVKGRFTISRDNAKSTLYLRMDSLRSEDTATYYCATHSRGTDYFDYWGQGVMVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6201 - protein, 1105 aa, Artificial Sequence
  Synthetic Polypeptide encoding a CAR with optional accessory module(s)
MALPVTALLLPLALLLHAARPDIVMTQSPSSLAVSEGETVTINCKSSQSFLSSGDGKNYVAWYQYKPGQSPKLLIYWASTRQSGVPDRFIGSGSGTDFTLTISTVQAEDLAIYYCQQYYDTPLTFGSGTKLEIKGGGGSGGGGSGGGGSEVKLQESGPSLVQSSQTLSLTCTVSGFSLTSYHIHWVRQTPGKGLEWMGVMWSDGDTSYNSALKSRLSISRDTSQSQVFLKMNSLQTEDTATYYCARGYYSSYLYLWFAYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6202 - protein, 1109 aa, Artificial Sequence
  Synthetic Polypeptide encoding a CAR with optional accessory module(s)
MALPVTALLLPLALLLHAARPDVLMTQTPVSLPVSLGGQVSISCRSSQSLVHSDGDTYLHWYLQKPGQSPQLLIYRVSNRFSGVPDRFSGSGSGTDFTLKISRVEPEDLGLYYCLQTTHFPPWTFGGGTKLEMKGGGGSGGGGSGGGGSQVQLQQSGPELRRPGSSVRLSCKASGYRIKDFLIHWIKNRPEHGLEWIGWIDPEDGETKYAQKFQTKATLTADTSSNTAYMQLSSLTSEDTATYFCARWGDVYYGLMRGHVMDAWGQGTSVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6203 - protein, 1100 aa, Artificial Sequence
  Synthetic Polypeptide encoding a CAR with optional accessory module(s)
MALPVTALLLPLALLLHAARPDIQMTQSTSSLSASLGDRVTISCSASQGINNYLNWYQQKPDGTVELLIYYTSTLQSGVPSRFSGSGSGTDYSLTISNLEPEDIGTYYCQQYSKLPRTFGGGTKLEIKGGGGSGGGGSGGGGSQVQLQQSGSELMMPGASVKISCKATGYTFSNYWIEWVKQRPGHGLEWIGEILPGTGRTIYNEKFKGKATFTADISSNTVQMQLSSLTSEDSAVYYCARRDYYGNFYYAMDYWGQGTSVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6204 - protein, 1095 aa, Artificial Sequence
  Synthetic Polypeptide encoding a CAR with optional accessory module(s)
MALPVTALLLPLALLLHAARPDIQMTQSPASLSVSVGETVTITCRASENIYSNLAWYQQKQGKSPQLLVYAATNLADGVPSRFSGSGSGTQYSLKINSLQSEDFGSYYCQHFWGTWTFGGGTTLEIKGGGGSGGGGSGGGGSEVQLQQSGPELVKPGASVKMSCKASGYTFTDYYMKWMKQSHGKSLEWIGDINPNNGGTTYNQKFKGKATLTVDKSSSTAYMQLNSLTSEDSAVYYCARDYGYGYFDYWGQGTTLTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6205 - protein, 1098 aa, Artificial Sequence
  Synthetic Polypeptide encoding a CAR with optional accessory module(s)
MALPVTALLLPLALLLHAARPEIVLTQSPGTLSLSPGERATLSCRASQSVGGYLAWYQQKPGQAPRLLIYDASNRATGIPARFSGSGSGTDFTLTISSLEPEDFAVYYCQQRNNWPPMYTFGQGTKLEIKRGGGGSGGGGSGGGGSQVQLVQSGAEVKKPGSSVKVSCKASGGTFSSYAISWVRQAPGQGLEWMGGIIPILGTANYAQKFQGRVTITADESTSTAYMELSSLRSEDTAVYYCARWGGGAFDIWGQGTMVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6206 - protein, 1093 aa, Artificial Sequence
  Synthetic Polypeptide encoding a CAR with optional accessory module(s)
MALPVTALLLPLALLLHAARPQIVLTQSPALMSASPGEKVTMTCSASSSVRYMYWYQQKPRSSPKPWIHLTSNLASGVPARFSGSGSGTSYSLTISSMEAEDAATYYCQQWSSHPFTFGSGTKLEIKGGGGSGGGGSGGGGSDVQLQESGPGLVKPSQSLSLTCTVTGFSITSDYSWNWIRQFPGNKLEWMGYISYSGHTSYNPSLESRISITRDTSKNQFFLQLNSVTTEDTATYYCTRGNWDVVYWGQGTLVTVSATRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6207 - protein, 1103 aa, Artificial Sequence
  Synthetic Polypeptide encoding a CAR with optional accessory module(s)
MALPVTALLLPLALLLHAARPDVVMTQSPLSLPVTLGQPASISCRSSQSIVHSDGNTYLEWYQQRPGQSPRRLIYKVSNRFSGVPDRFSGSGSGTDFTLKISRVEAEDVGVYYCFQGSHAPWTFGGGTKVEIKGGGGSGGGGSGGGGSEVQLVESGGGLVQPGGSLRLSCAASGFTFSSYGMHWVRQAPGKGLEWVAYITTRSSTIYYADSVKGRFTISRDNAKNSLYLQMNSLRAEDTAVYYCTREPLTGYYAMDYWGQGTSVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6208 - protein, 1095 aa, Artificial Sequence
  Synthetic Polypeptide encoding a CAR with optional accessory module(s)
MALPVTALLLPLALLLHAARPDIQMTQSPSSLSASVGDRVTITCRASQSISLWLNWYQQKPGKAPKLLIYAASTLQSGVPSRFSGSGSGTDFTLTISSLQPEDFATYYCQQYYTSPYTFGQGTKVEIKRGGGGSGGGGSGGGGSQVQLLESGGGLVQPGGSLRLSCAASGFTFSSYAMSWVRQAPGKGLEWVSVIRSSGSSTYYADSVKGRFTISRDNSKNTLYLQMNSLRAEDTAVYYCARGGGYFDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6209 - protein, 1098 aa, Artificial Sequence
  Synthetic Polypeptide encoding a CAR with optional accessory module(s)
MALPVTALLLPLALLLHAARPDIQMTQSPSSLSASVGDRVTITCRASQSISSYLNWYQQKPGKAPKLLIYAVSTLQSGVPSRFSGSGSGTDFTLTISSLQPEDFATYYCQQSGTFPPTTFGQGTKVEIKRGGGGSGGGGSGGGGSQVQLLESGGGLVQPGGSLRLSCAASGFTFSSHGMHWVRQAPGKGLEWVSVISGSGSNTGYADSVKGRFTISRDNSKNTLYLQMNSLRAEDTAVYYCARQWGSYAFDSWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6210 - protein, 1108 aa, Artificial Sequence
  Synthetic Polypeptide encoding a CAR with optional accessory module(s)
MALPVTALLLPLALLLHAARPDIVMSQSPSSLAVSVGEKVTMSCKSSQSLLHSSNQKNYLAWYQQKPGQSPKVLIYWASTRESGVPDRFTGSGSGTDFTLTITSVKSEDLAVYYCQQYYSYPWTFGGGTRLEIKRGGGGSGGGGSGGGGSEVQLQQSVAELVKPGASVKMSCKVSGYTLTDHTIHWMKQRPEQGLEWIGYIYPRDGITGYNEKFKGKATLTADTSSSTAYMQLNSLTSEDSAVYFCARWGYSYRNYAYYYDYWGQGTTLTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6211 - protein, 1105 aa, Artificial Sequence
  Synthetic Polypeptide encoding a CAR with optional accessory module(s)
MALPVTALLLPLALLLHAARPEIVLTQSPGTLSLSPGERATLSCRASQSVSSSYLAWYQQKPGQAPRLLIYGTSSRATGIPDRFSGSGSGTDFTLTISRLEPEDFAVYYCQQYGSSPFTFGGGTKVEIKRGGGGSGGGGSGGGGSQVQLQESGPGLAKPSETLSLTCTVSGDSITSYYWSWIRQPPGKGLEWIGYIYYSGSTNYNPSLKSRVTISVDTSKNQFSLKLSSVTAADTAVYYCARDQRRIAAAGTHFYGMDVWGQGTTVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6212 - protein, 1097 aa, Artificial Sequence
  Synthetic Polypeptide encoding a CAR with optional accessory module(s)
MALPVTALLLPLALLLHAARPDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKGGGGSGGGGSGGGGSQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSATRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6213 - protein, 1090 aa, Artificial Sequence
  Synthetic Polypeptide encoding a CAR with optional accessory module(s)
MALPVTALLLPLALLLHAARPMTQSPKFLLVSAGDRVTLTCKASQSVNNDVYWYQQEPGQSPKLLIYWASTRESGVPDRFTGSGSGTDFTLTISSVQAEDLAVYYCKQSYNLYTFGGGTKLEIKRGGGGSGGGGSGGGGSESGRGLVQPGGSRKLSCAASGFTFSTSGMHWVRQAPEKGLEWVAYISSGSTTIYHADTVKGRFTISRDNPKNTLFLQMTSLRSEDTAMYYCCARSGQFGNYFDYWGQGTTLTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6214 - protein, 1095 aa, Artificial Sequence
  Synthetic Polypeptide encoding a CAR with optional accessory module(s)
MALPVTALLLPLALLLHAARPQSPSSLAVSAGEKVTMSCKSSQSLLNSRTRKNYLAWYQQKPGQSPKLLIYWASTRESGVPDRFTGSGSGTDFTLTISSVQAEDLAVYYCKQSNLYTFGGGTKLEIKGGGGSGGGGSGGGGSQVQLEESGPELVKPGASVKLSCKASGYTFTEYIIHWVKQRSGQGLEWIGWFYPGSGSIKYNEKFKDKATLTADKSSSTVYMELSGLTSEDSAVYFCARHDGYSYFDYWGQGTTLTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6215 - protein, 1107 aa, Artificial Sequence
  Synthetic Polypeptide encoding a CAR with optional accessory module(s)
MEMFQGLLLLLLLSMGGTWASREMLRPRCRPINATLAVEKEGCPVCITVNTTICAGYCPTMTRVLQGVLPALPQVVCNYRDVRFESIRLPGCPRGVNPVVSYAVALSCQCALCRRSTTDCGGPKDHPLTCDDPRFQASSSSKAPPPSLPSPSRLPGPSDTPILPQGGGGSGGGGSGGGGSAPDVQDCPECTLQENPFFSQPGAPILQCMGCCFSRAYPTPLRSKKTMLVQKNVTSESTCCVAKSYNRVTVMGGFKVENHTACHCSTCYYHKSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6216 - protein, 1098 aa, Artificial Sequence
  Synthetic Polypeptide encoding a CAR with optional accessory module(s)
MALPVTALLLPLALLLHAARPDIQMTQSPSSLSASLGERVSLTCRATQELSGYLSWLQQKPDGTIKRLIYAASTLDSGVPKRFSGNRSGSDYSLTISSLESEDFADYYCLQYAIYPYTFGGGTKLEIKGGGGSGGGGSGGGGSEVQLQQSGPELVKPGASVKMSCKASGYTFTSYFIHWVKQKPGQGLEWIGFINPYNDGSKYNEKFKGKATLTSDKSSSTAYMELSSLTSEDSAVYYCTRDDGYYGYAMDYWGQGTSVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6217 - protein, 1103 aa, Artificial Sequence
  Synthetic Polypeptide encoding a CAR with optional accessory module(s)
MALPVTALLLPLALLLHAARPDTIVLTQSPASLAVSLGQRATISCRASESVDSYGNSFMHWYQQKPGQPPKLLIYLASNLESGVPARFSGSGSRTDFTLTIDPVEADDAATYYCQQNNYDPWTFGGGTKLEIKGGGGSGGGGSGGGGSEVQLQQSGPELVKPGASVKMSCKASGYTFTSYVMHWVKQKPGQGLEWIGYINPYNDGTKYNEKFKGKATLTSDTSSSTAYMELNSLTSEDSAVYFCARPIYFDNDYFDYWGQGTTLKVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6218 - protein, 1098 aa, Artificial Sequence
  Synthetic Polypeptide encoding a CAR with optional accessory module(s)
MALPVTALLLPLALLLHAARPDIQMTQSPSSLSASVGDRVTITCKASQDVSTAVAWFQQKPGKAPKLLIYSPSYRYTGVPSRFSGSGSGTDFTLTISSLQPEDFTYYCQQLYSTPYTFGQGTKVEIKGGGGSGGGGSGGGGSEVQLVQSGAEVKKPGASVKVSCKASGYTFTDYYLDVVVRQAPGQGLEWIGRVNPYNGGTIYNQKFKGRVTLTRDTSTSTAYLELSSLRSEDTAVYYCARDHYRYDPLLDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6219 - protein, 1104 aa, Artificial Sequence
  Synthetic Polypeptide encoding a CAR with optional accessory module(s)
MALPVTALLLPLALLLHAARPDIQMTQSPSSLSASVGDRVTITCRASQSVSTSSYNYMHWYQQKPGKPPKLLIKYASNLESGVPSRFSGSGSGTDFTLTISSLQPEDFATYYCQHSWEIPLTFGQGTKVEIKGGGGSGGGGSGGGGSEVQLVQSGAEVKKPGASVKVSCKASGYSFTDYYMHWVRQAPGQGLEWIGRINPYNGAAFYSQNFKDRVTLTVDTSTSTAYLELSSLRSEDTAVYYCAIERGADLEGYAMDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6220 - protein, 1102 aa, Artificial Sequence
  Synthetic Polypeptide encoding a CAR with optional accessory module(s)
MALPVTALLLPLALLLHAARPEIVLTQSPATLSASPGERVTLTCRASSNVISSYVHWYQQKPGSSPRLFLYSTSNLASGVPSRFSGSGSGTDFTFTISSLEAEDAATYYCQQYSGYPLTFGQGTRLEIKGGGGSGGGGSGGGGSQVQLQESGPGLVKPSETLSLTCAVSGYSITSAYYWNWIRQPPGKGLEWIGYISYDGRNNYNPSLKNRITINPDTSKNQFSLQLNSVTPEDTAVYYCAREGDYDVGNYYAMDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6221 - protein, 1102 aa, Artificial Sequence
  Synthetic Polypeptide encoding a CAR with optional accessory module(s)
MALPVTALLLPLALLLHAARPEIVLTQSPATLSLSPGERATLSCRASSNVISSYVHWYQQKPGQAPRLLIYSTSNLASGIPARFSGSGSGTDFTLTISSLEPEDFAVYYCQQYSGYPLTFGQGTRLEIKGGGGSGGGGSGGGGSEVQLVESGGGLVQPGRSLRLSCAASGYSITSAYYWNWVRQAPGKGLEWVSYISYDGRNNYNPSLKNRFTISRDNAKKSLYLQMNSLRAEDTALYYCAKEGDYDVGNYYAMDYWGQGTTVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6222 - protein, 1114 aa, Artificial Sequence
  Synthetic Polypeptide encoding a CAR with optional accessory module(s)
MALPVTALLLPLALLLHAARPDLNFMLTQPHSVSGSPGKTVTISCTRSTGSITSNYVHWYQQRPGSSPTTVICEDNERPSGVPDRFSGSIDISSNSASLTISGLKTEDEADYYCQSYDDSNHISVFGTGTKVTVLGQPKANPGGGGSGGGGSGGGGSQVQLQESGPGLVKPSETLSLTCTVSGGSISSSNYYWGWIRQPPGKGLEWIGAIYYSGSTYYNPSLKSRVAISVDTSKNQFSLKLSSVTAADTAVYYCARRIGVAGQWYFDLWGRGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6223 - protein, 1100 aa, Artificial Sequence
  Synthetic Polypeptide encoding a CAR with optional accessory module(s)
MALPVTALLLPLALLLHAARPDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKGGGGSGGGGSGGGGSQIQLVQSGPDLKKPGETVKISCKASGYTFTNTGMNWVKQAPGKGLKWMGWINTYTGEPTYADDFKGRFTFSLETSASTAYLQINNLKNEDTATYFCTRWGYGSSLYYAMDYWGQGTSVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6224 - protein, 1097 aa, Artificial Sequence
  Synthetic Polypeptide encoding a CAR with optional accessory module(s)
MALPVTALLLPLALLLHAARPDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKGGGGSGGGGSGGGGSEVQLVESGGGLVQPGGSLRLSCAASGFDFSRYWMSWVRQAPGKGLEWIGEINPDSSTINYAPSLKDKFIISRDNAKNSLYLQMNSLRAEDTAVYYCARPDGNYWYFDVWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6225 - protein, 1098 aa, Artificial Sequence
  Synthetic Polypeptide encoding a CAR with optional accessory module(s)
MALPVTALLLPLALLLHAARPDIVMTQSQKSMSTSVGDRVSITCKASQDVITGVAWYQQKPGQSPKLLIYSASYRYTGVPDRFTGSGSGTDFTFTISNVQAEDLAVYYCQQHYSTPLTFGAGTKLELKGGGGSGGGGSGGGGSQVQLQQPGAELVRPGASVKLSCKASGYSFTTYWMNWVKQRPGQGLEWIGMIHPSDSETRLNQKFKDKATLTVDKSSSTAYMQLSSPTSEDSAVYYCARSTMIATRAMDYWGQGTSVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6226 - protein, 1100 aa, Artificial Sequence
  Synthetic Polypeptide encoding a CAR with optional accessory module(s)
MALPVTALLLPLALLLHAARPDIQMTQSPSSLSASVGDRVTITCKASQDVSTAVAWYQQKPGKAPKLLIYSASYRYTGVPDRFTGSGSGTDFTLTISSLQPEDFATYYCQQHYSTPPYTFGGGTKVEIKRGGGGSGGGGSGGGGSQVQLVQSGAEVKKPGASVKVSCKASGYAFSSSWMNWVRQAPGQGLEWIGRIYPGDGDTKYNGKFKGKATLTADKSTSTAYMELSSLRSEDTAVYYCARSTMIATGAMDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6227 - protein, 1101 aa, Artificial Sequence
  Synthetic Polypeptide encoding a CAR with optional accessory module(s)
MALPVTALLLPLALLLHAARPDVVMTQTPLSLSVTPGQPASISCRSSQSLVHNNGNTYLHWYLQKPGQSPQLLIYKVSNRFSGVPDRFSGSGSGTDFTLKISRVEAEDVGVYFCSQSTHVPPYTFGGGTKVEIKGGGGSGGGGSGGGGSEVQLVESGGGLVQPGGSLRLSCAASGFTFSDYYMAWVRQAPGKGLEWVAEINYDGSSTYYVDSVKGRFTISRDNAKNSLYLQMNSLRAEDTAVYYCARDRGFYFDYWGQGTTVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6228 - protein, 1101 aa, Artificial Sequence
  Synthetic Polypeptide encoding a CAR with optional accessory module(s)
MALPVTALLLPLALLLHAARPDVVMTQTPLSLSVTPGQPASISCRSSQSLVHSNGLTYLHWYLQKPGQSPQLLIYKVSNRFSGVPDRFSGSGSGTDFTLKISRVEAEDVGVYFCSQSTHVPPFTFGGGTKVEIKGGGGSGGGGSGGGGSEVQLVESGGGLVQPGGSLRLSCAASGFTFSDYYMAWVRQAPGKGLEWVASINYDGESTYYVDSVKGRFTISRDNAKNSLYLQMNSLRAEDTAVYYCARDRGYYFDYWGQGTTVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6229 - protein, 1101 aa, Artificial Sequence
  Synthetic Polypeptide encoding a CAR with optional accessory module(s)
MALPVTALLLPLALLLHAARPDVVMTQSPLSLPVTPGEPASISCRSSQSLVHSNGNTYLHWYLQKPGQSPQLLIYKVSNRFSGVPDRFSGSGSGTDFTLKISRVEAEDVGVYFCSQSTHVPPFTFGGGTKVEIKGGGGSGGGGSGGGGSEVQLVESGGGLVQPGGSLRLSCAASGFTFSDYYMAWVRQAPGKGLEWVADINYDGGSTYYLDSLKSRFTISRDNAKNSLYLQMNSLRAEDTAVYYCARDRGYYFDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6230 - protein, 1099 aa, Artificial Sequence
  Synthetic Polypeptide encoding a CAR with optional accessory module(s)
MALPVTALLLPLALLLHAARPDIQMTQSSSYLSVSLGGRVTITCKASDHINNWLAWYQQKPGNAPRLLISGATSLETGVPSRFSGSGSGKDYTLSITSLQTEDVATYYCQQYWSTPWTFGGGTKLEIKGGGGSGGGGSGGGGSQVQLQQSGAELARPGASVKLSCKASGYTFTSYWMQWVKQRPGQGLEWIGAIYPGDGDTRYTQKFKGKATLTADKSSSTAYMQLSSLASEDSAVYYCARGKVYYGSNPFAYWGQGTLVTVSATRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6231 - protein, 1099 aa, Artificial Sequence
  Synthetic Polypeptide encoding a CAR with optional accessory module(s)
MALPVTALLLPLALLLHAARPDIVMTQSHKFMSTSVGDRVSITCKASQDVSTAVAWYQQKPGQSPKLLIYSASYRYTGVPDRFTGSGSGTDFTFTISSVQAEDLAVYYCQQHYSTPPYTFGGGTKLEIKGGGGSGGGGSGGGGSQVQLQQSGPELVKPGASVKISCKASGYAFSSSWMNWVKQRPGQGLEWIGRIYPGDGDTKYNGKFKGKATLTADKSSSTAYMQLSSLTSVDSAVYFCARSTMIATGAMDYWGQGTSVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6232 - protein, 1104 aa, Artificial Sequence
  Synthetic Polypeptide encoding a CAR with optional accessory module(s)
MALPVTALLLPLALLLHAARPQSVLTQPPSVSGAPGQRVTISCTGSGSNIGAPYDVSWYQQLPGTAPKLLIYHNNKRPSGVPDRFSGSKSGTSASLAITGLQAEDEADYYCATVEAGLSGSVFGGGTKLTVLGAGGGGSGGGGSGGGGSQVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSPLTLGLWGQGTMVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6233 - protein, 1104 aa, Artificial Sequence
  Synthetic Polypeptide encoding a CAR with optional accessory module(s)
MALPVTALLLPLALLLHAARPQSVLTQPPSVSGAPGQRVTISCTGSGSNIGAPYDVSWYQQLPGTAPKLLIYHNNKRPSGVPDRFSGSKSGTSASLAITGLQAEDEADYYCQSYDSSSISTIFGGGTKLTVLGAGGGGSGGGGSGGGGSQVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSGIAYRPWGQGTMVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6234 - protein, 1115 aa, Artificial Sequence
  Synthetic Polypeptide encoding a CAR with optional accessory module(s)
MALPVTALLLPLALLLHAARPDEFEVQLVESGGGLVQAGGSLRLSCVASGISSSKRNMGWYRQAPGKQRESVATISSGGNKDYTDAVKDRFTISRDTTKNTVYLQMNSLKPEDTAVYYCKIEAGTGWATRRGYTYWGQGTLVTVSSLEGGGGSGGGGSGGGGSFEVQLVESGGGLVQAGGSLRLSCAASGSIFSGNVMGWYRRQAPGKEREWVAAIASGGSIYYRDSVKGRFTISRDNAKNTVYLQMNSLKPEDTAVYYCNSHPPTLPYWGLGTQVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6235 - protein, 1149 aa, Artificial Sequence
  Synthetic Polypeptide encoding a CAR with optional accessory module(s)
MALPVTALLLPLALLLHAARPDEFEVQLVESGGGLVQAGDSLRLSCAASGRAFSRYAMGWFRQAPGKEREFVAAIGWGPSKTNYADSVKGRFTISRDNAKNTVYLQMNTLKPEDTAVYSCAAKFVNTDSTWSRSEMYTYWGQGTLVTVSSLEGGGGSGGGGSGGGGSGSGGSGSGGSGSGGSGSGGSFEVQLVESGGGSVQAGGSLRLSCTTSGRALNMYVMGWFRQAPGNEREFVAATSSSGGSTSYPDSVKGRFTISRDNAKNTVYLQMNSLKPEDTAAYRCAASPYVSTPTMNILEEYRYWGLGTQVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6236 - protein, 1102 aa, Artificial Sequence
  Synthetic Polypeptide encoding a CAR with optional accessory module(s)
MALPVTALLLPLALLLHAARPDIQMTQSPSSLSASVGDRVTITCSASSSVSYMYWYQQKPGKAPKLLIYLTSNLASGVPSRFSGSGSGTDFTLTISSLQPEDFATYYCQQWRSNPFTFGQGTKLEIKRGGGGSGGGGSGGGGSQITLKESGPTLVKPTQTLTLTCTFSGFSLSTSGMGVGWIRQPPGKALEWLAHIWWDDVKRYSPSLKSRLTITKDTSKNQVVLTMTNMDPVDTATYYCARIVSFDNDVVSAMDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6237 - protein, 1097 aa, Artificial Sequence
  Synthetic Polypeptide encoding a CAR with optional accessory module(s)
MALPVTALLLPLALLLHAARPEIVMTQSPATLSVSPGERATLSCKASQSVSNDVVWYQQKPGQAPRLLIYYASNRYTGIPARFSGSGSGTEFTLTISSLQSEDFAVYYCQQDYTSPWTFGQGTKLEIKRGGGGSGGGGSGGGGSQVQLVQSGAEVKKPGASVKVSCKASGYTFTNYGMNWVRQAPGQGLEWMGWINTYTGEPTYADDFKGRVTMTTDTSTSTAYMELRSLRSDDTAVYYCARIGDSSPSDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6238 - protein, 1098 aa, Artificial Sequence
  Synthetic Polypeptide encoding a CAR with optional accessory module(s)
MALPVTALLLPLALLLHAARPDSTDIQMTQSPSSLSASVGDRVTITCRASQSISSYLNWYQQKPGKAPKLLIYLASNLQSGVPSRFSGSGSGTDFTLTISSLQPEDFATYYCQQAEYMPLTFGQGTKVEIKRAGGGGSGGGGSGGGGSEVQLLESGGGLVQPGGSLRLSCAASGFTFSGYAMSWVRQAPGKGLEWVSEIAPPGLNTRYADSVKGRFTISRDNSKNTLYLQMNSLRAEDTAVYYCAKSDTAFDYWGQGTLVTVSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6239 - protein, 1101 aa, Artificial Sequence
  Synthetic Polypeptide encoding a CAR with optional accessory module(s)
MALPVTALLLPLALLLHAARPDQAVLTQESALTTSPGETVTLTCRSSTGAVTTSNYANWVQEKPDHLFTGLIGGTNNRVPGVPARFSGSLIGDKAALTITGAQTEDEAIYFCVLWHSNHWVFGGGTKLTVLGGGGSGGGGSGGGGSDVQLVESGGGLVQPGGSRKLSCAASGFTFSSFGMHWVRQAPEKGLEWVAYISSGSSTLHYADTVKGRFTISRDNPKNTLFLQMTSLRSEDTAMYYCARWGNYPHYAMDYWGQGTSVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6240 - protein, 983 aa, Artificial Sequence
  Synthetic Polypeptide encoding a CAR with optional accessory module(s)
MALPVTALLLPLALLLHAARPDEFEVQLVESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6241 - protein, 1125 aa, Artificial Sequence
  Synthetic Polypeptide encoding a CAR with optional accessory module(s)
MALPVTALLLPLALLLHAARPDEFEVQLVESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTLVTVSSLEGGGGSGGGGSGGGGSFEEVQLVESGGGSVQAGGSLRLSCAASGDTYGSYWMGWFRQAPGKEREGVAAINRGGGYTVYADSVKGRFTISRDTAKNTVYLQMNSLRPDDTADYYCAASGVLGGLHEDWFNYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6242 - protein, 1144 aa, Artificial Sequence
  Synthetic Polypeptide encoding a CAR with optional accessory module(s)
MALPVTALLLPLALLLHAARPDEFEVQLVESGGGSVQAGGSLRLTCAASGSTSRSYGMGWFRQAPGKEREFVSGISWRGDSTGYADSVKGRFTISRDNAKNTVDLQMNSLKPEDTAIYYCAAAAGSTWYGTLYEYDYWGQGTLVTVSSLEGGGGSGGGGSGGGGSGSGGSGSGGSGSGGSGSGGSFEVQLVESGGGSVQAGGSLRLSCAASGDTYGSYWMGWFRQAPGQEREAVAAINRGGGYTVYADSVKGRFTISRDNAKNTLYLQMNSLRPDDTADYYCAASGVLGGLHEDWFNYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6243 - protein, 1092 aa, Artificial Sequence
  Synthetic Polypeptide encoding a CAR with optional accessory module(s)
MALPVTALLLPLALLLHAARPDIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVEGGGGSGGGGSGGGGSEVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6244 - protein, 1098 aa, Artificial Sequence
  Synthetic Polypeptide encoding a CAR with optional accessory module(s)
MALPVTALLLPLALLLHAARPDEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSGGGGSGGGGSGGGGSDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6245 - protein, 1105 aa, Artificial Sequence
  Synthetic Polypeptide encoding a CAR with optional accessory module(s)
MALPVTALLLPLALLLHAARPDELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6246 - protein, 1106 aa, Artificial Sequence
  Synthetic Polypeptide encoding a CAR with optional accessory module(s)
MALPVTALLLPLALLLHAARPDELQMTQSPSSLSASVGDRVTITCRASQSISSYLNWYQQKPGQPPKLLIYWASTRESGVPDRFSGSESGTNYTLTISSLQPEDFATYFCQQSDSLPITFGQGTRLDIQGGGGSGGGGSGGGGSEVQLLESGGGVVQPGRSLRLSCAASGFTFSSYGMHWVRQAPGKGLEWVAVISYDGSNKYYADSVKGRFTISRDNSKNTLYLQMNSLRAEDTAVYYCAKDMGWGSGWRPYYYYGMDVWGQGTTVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6247 - protein, 1103 aa, Artificial Sequence
  Synthetic Polypeptide encoding a CAR with optional accessory module(s)
MALPVTALLLPLALLLHAARPDDIQMTQSPSSLSASVGDRVTITCRASQSISSYLNWYQQKPGKAPKLLIYAASSLQSGVPSRFSGSGSGTDFTLTISSLQPEDLATYYCQQSYSTPFTFGPGTKVDIKGGGGSGGGGSGGGGSVHEVQLVQSGAEVKKPGSSVKVSCKASGGTFSSYAISWVRQAPGQGLEWMGGIIPIFGTANYAQKFQGRVTITADKSTSTAYMELSSLRSEDTAVYYCATFALFGFREQAFDIWGQGTTVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6248 - protein, 1100 aa, Artificial Sequence
  Synthetic Polypeptide encoding a CAR with optional accessory module(s)
MALPVTALLLPLALLLHAARPDVVMTQTPLSLPVSLGDQASISCRSSQSLVHSNGNTYLRWYLQKPGQSPKVLIYKVSNRFSGVPDRFSGSGSGTDFTLKISRVEAEDLGVYFCSQSTHVPWTFGGGTKLEIKGGGGSGGGGSGGGGSEVKLDETGGGLVQPGRPMKLSCVASGFTFSDYWMNWVRQSPEKGLEWVAQIRNKPYNYETYYSDSVKGRFTISRDDSKSSVYLQMNNLRVEDMGIYYCTGSYYGMDYWGQGTSVTVSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6249 - protein, 1111 aa, Artificial Sequence
  Synthetic Polypeptide encoding a CAR with optional accessory module(s)
MALPVTALLLPLALLLHAARPDVVMTQTPLSLPVSLGDQASISCRSSQSLVHSNGNTYLRWYLQKPGQSPKVLIYKVSNRVSGVPDRFSGSGSGTDFTLKINRVEAEDLGVYFCSQSTHVPWTFGGGTKLEIKSSADDAKKDAAKKDDAKKDDAKKDGGVKLDETGGGLVQPGGAMKLSCVTSGFTFGHYWMNWVRQSPEKGLEWVAQFRNKPYNYETYYSDSVKGRFTISRDDSKSSVYLQMNNLRVEDTGIYYCTGASYGMEYLGQGTSVTVSTTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6250 - protein, 1107 aa, Artificial Sequence
  Synthetic Polypeptide encoding a CAR with optional accessory module(s)
MALPVTALLLPLALLLHAARPQVQLVESGGNLVQPGGSLRLSCAASGFTFGSFSMSWVRQAPGGGLEWVAGLSARSSLTHYADSVKGRFTISRDNAKNSVYLQMNSLRVEDTAVYYCARRSYDSSGYWGHFYSYMDVWGQGTLVTVSGGGGSGGGGSGGGGSSVLTQPSSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLGTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6251 - protein, 1102 aa, Artificial Sequence
  Synthetic Polypeptide encoding a CAR with optional accessory module(s)
MALPVTALLLPLALLLHAARPDIQMTQSPSSLSASVGDRVTITCRTSQSLSSYTHWYQQKPGKAPKLLIYAASSRGSGVPSRFSGSGSGTDFTLTISSLQPEDFATYYCQQSRTFGQGTKVEIKGGGGSGGGGSGGGGSQVQLQQSGPGLVKPSQTLSLTCAISGDSVSSYNAVWNWIRQSPSRGLEWLGRTYYRSGWYNDYAESVKSRITINPDTSKNQFSLQLNSVTPEDTAVYYCARSGHITVFGVNVDAFDMWGQGTMVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6252 - protein, 1101 aa, Artificial Sequence
  Synthetic Polypeptide encoding a CAR with optional accessory module(s)
MALPVTALLLPLALLLHAARPDIVLTQSPLSLAVSLGQPAIISCKASQSVSFAGTSLMHWYHQKPGQQPRLLIYRASNLEAGVPDRFSGSGSKTDFTLTISPVEAEDAATYYCQQSREYPYTFGGGTKLEIKRGGGGSGGGGSGGGGSQVQLVQSGAEVVKPGASVKISCKASGYTFTGYFMNWVKQSPGQSLEWIGRIHPYDGDTFYNQKFQGKATLTVDKSSNTAHMELLSLTSEDFAVYYCTRYDGSRAMDYWGQGTTVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6253 - protein, 1074 aa, Artificial Sequence
  Synthetic Polypeptide encoding a CAR with optional accessory module(s)
MALPVTALLLPLALLLHAARPNSCELTNITIAIEKEECRFCISINTTWCAGYCYTRDLVYKDPARPKIQKTCTFKELVYETVRVPGCAHHADSLYTYPVATQCHCGKCDSDSTDCTVRGLGPSYCSFGEMKEGGGGSGGGGSGGGGSAPDVQDCPECTLQENPFFSQPGAPILQCMGCCFSRAYPTPLRSKKTMLVQKNVTSESTCCVAKSYNRVTVMGGFKVENHTACHCSTCYYHKSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6254 - protein, 1105 aa, Artificial Sequence
  Synthetic Polypeptide encoding a CAR with optional accessory module(s)
MALPVTALLLPLALLLHAARPDLETTLTQSPATLSVSPGERVTLSCRASQSVGSNLAWYQQKFGQAPRLLIYDASTRATGIPARFSGSGSGTEFTLTISRLEPEDFAVYYCHQYGSSPRTFGQGTKVDIKRGGGGSGGGGSGGGGSQVQLVQSGAEVKKPGASVKVSCKASGYTFTTYGISWVRQAPGQGLEWMGWISAYNGHTNYAQMLQGRVTMTTDTSTSTAYMELRGLRSDDTAVYYCAREAYASYGSGSYWTDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6255 - protein, 1098 aa, Artificial Sequence
  Synthetic Polypeptide encoding a CAR with optional accessory module(s)
MALPVTALLLPLALLLHAARPDDVVMTQTPLSLPVTPGEPASISCRSSQSLVHRNGNTYLHWYLQKPGQSPKLLIHKVSNRFSGVPDRFSGSGSGTDFTLKISRVEAEDLGVYFCSQSTHVPPLTFGAGTKLELKGGGGSGGGGSGGGGSEVQLVQSGAEVEKPGASVKISCKASGSSFTGYNMNWVRQNIGKSLEWIGAIDPYYGGTSYNQKFKGRATLTVDKSTSTAYMHLKSLRSEDTAVYYCVSGMEYWGQGTSVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6256 - protein, 1096 aa, Artificial Sequence
  Synthetic Polypeptide encoding a CAR with optional accessory module(s)
MALPVTALLLPLALLLHAARPDEIVMTQTPATLSVSAGERVTITCKASQSVSNDVTWYQQKPGQAPRLLIYSASNRYSGVPARFSGSGYGTEFTFTISSVQSEDFAVYFCQQDYSSFGQGTKLEIKRGGGGSGGGGSGGGGSQVQLVESGPGVVQPGRSLRISCAVSGFSVTNYGVHWVRQPPGKGLEWLGVIWAGGITNYNSAFMSRLTISKDNSKNTVYLQMNSLRAEDTAMYYCASRGGHYGYALDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6257 - protein, 1098 aa, Artificial Sequence
  Synthetic Polypeptide encoding a CAR with optional accessory module(s)
MALPVTALLLPLALLLHAARPDIQMTQTASSLPASLGDRVTISCSASQDISNYLNWYQQKPDGTVKLLIFYSSNLHSGVPSRFSGGGSGTDYSLTISNLEPEDIATYFCHQYSKLPWTFGGGTKLEIKRGGGGSGGGGSGGGGSEVTLVESGGDFVKPGGSLKVSCAASGFAFSHYAMSWVRQTPAKRLEWVAYISSGGSGTYYSDSVKGRFTISRDNAKNTLYLQMRSLRSEDSAMYFCTRVKLGTYYFDSWGQGTTLTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6258 - protein, 1100 aa, Artificial Sequence
  Synthetic Polypeptide encoding a CAR with optional accessory module(s)
MALPVTALLLPLALLLHAARPQFVLTQSPSASAALGASAKLTCTLSSAHKTYTIDWYQQQKGKAPRYLIQVKSDGTYTKATGVPDRFSGSSSGADRYLIIPSVQADDEADYYCGTDYTGGYVFGGGTQLTVTGGGGSGGGGSGGGGSEQLKESGGGLFKPTDTLTLTCTVSGFSLSYYGVNWVRQAPGNGLEWIGTIGGSGDTYYASWAKSRSTIIRNTNENTVTLKMTSLTAADTATYFCVRYANIGYEYFNVWGPGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6259 - protein, 1105 aa, Artificial Sequence
  Synthetic Polypeptide encoding a CAR with optional accessory module(s)
MALPVTALLLPLALLLHAARPQFVLTQSPSVSAALGASAKLTCTLSSAHKTYTIDWYQQQQGEAPRYLMQVKSDGSYTKGTGVPDRFSGSSSGADRYLIIPSVQADDEAGYVCGADDNGGYVFGGGTQLTVTGGGGSGGGGSGGGGSQSVKESEGGLFKPTDTLTLTCTVSGFSLSRHALTWVRQAPGNGLEWIGAIDNAGTTYYASWAKSRSTITRNTDLHTVTLKMTSLTASDTATYFCARVFYDINSGYYLDGMDLWGPGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6260 - protein, 1099 aa, Artificial Sequence
  Synthetic Polypeptide encoding a CAR with optional accessory module(s)
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKGGGGSGGGGSGGGGSEVQLVESGGGLVQPGESLRLSCVASGFTFSRYKMNWVRQAPGKGLEWVSYISRSGRDIYYADSVKGRFTISRDNAKNSLYLQMNSLRDEDTAVYYCAGTVTTYYYFGMDVWGHGTTVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6261 - protein, 1100 aa, Artificial Sequence
  Synthetic Polypeptide encoding a CAR with optional accessory module(s)
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKGGGGSGGGGSGGGGSEVQLVESGGGSVQPGESLRLSCVASGFTFSRYKMNWVRQAPGKGLEWVSYISRSGRDIYYADSVKGRFTISRDNAKNSLYLQMNSLRDEDTAVYYCAGTVTTYYYDFGMDVWGQGTTVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6262 - protein, 1099 aa, Artificial Sequence
  Synthetic Polypeptide encoding a CAR with optional accessory module(s)
MALPVTALLLPLALLLHAARPQSVLTQPPSASGTPGQRVTISCSGSRSNVGGNYVFWYQQVPGATPKLLIYRSNQRPSGVPDRFAGSKSGSSASLAISGLRSEDEADYYCATWDDSLSGFVFGTGTKVTVLGGGGGSGGGGSGGGGSEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARGYGKAYDQWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6263 - protein, 1098 aa, Artificial Sequence
  Synthetic Polypeptide encoding a CAR with optional accessory module(s)
MALPVTALLLPLALLLHAARPQSVVTQPPSMSAAPGQQVTISCSGGNSNIERNYVSWYLQLPGTAPKLVIFDNDRRPSGIPDRFSGSKSGTSATLGITGLQTGDEADYYCGTWDSSLRGWVFGGGTKLTVLGGGGGSGGGGSGGGGSEVQLVESGGGLIQPGGSLRLSCAASGFTFSNYAMNWVRQAPGKGLEWVSTINGRGSSTIYADSVKGRFTISRDNSKNTLYLQMNSLRAEDTATYYCARYISRGLGDSWGQGTLVTVTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6264 - protein, 1098 aa, Artificial Sequence
  Synthetic Polypeptide encoding a CAR with optional accessory module(s)
MALPVTALLLPLALLLHAARPQSVVTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSYVFGTGTKLTVLGGGGGSGGGGSGGGGSEVQLVETGGNLVQPGASLRLSCAASGFSFSGTAMHWVRQAPGKGLEWVSTISSTGRSTYYRDSVKGRFTISRDNSKNTLYLQMNSLRGEDTAVYYCARVSFDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6265 - protein, 1100 aa, Artificial Sequence
  Synthetic Polypeptide encoding a CAR with optional accessory module(s)
MALPVTALLLPLALLLHAARPQSVVTQPASVSGSPGQSITISCTGTSSDVGGYNYVSWYQQHPGKAPKLMIYDVSKRPSGVSNRFSGSKSGNTASLTISGLQAEDEADYYCSSYTSSSTLVFGGGTKLTVLGGGGGSGGGGSGGGGSEVQLVESGGAFVQPGGSLRLSCAASGFTFSSYAMTWVRQAPGKGLEWVSTISGRGRSTFYADSVKGRFTISRDNSKNTLYLQMNSLRAEDTAVYYCARYYHAGAFDLWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6266 - protein, 1098 aa, Artificial Sequence
  Synthetic Polypeptide encoding a CAR with optional accessory module(s)
MALPVTALLLPLALLLHAARPDNIELTQSPAIMSASPGERVTMTCSASSSIRYIYWYQQKPGSSPRLLIYDTSNVAPGVPFRFSGSGSGTSYSLTINRMEAEDAATYYCQEWSGYPYTFGGGTKLDIKRGGGGSGGGGSGGGGSQVKLQESGGGLVKPGGSLKLSCAASGFTFSSYGMSWVRQTPDKRLEWVATISSGGSYTYYPDSVKGRFTISRDNAKNTLYLQMSSLKSEDTAMYYCARGNWEGWYFDVWGQGTTVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6267 - protein, 1108 aa, Artificial Sequence
  Synthetic Polypeptide encoding a CAR with optional accessory module(s)
MALPVTALLLPLALLLHAARPDNFMLTQPHSVSESPGKTVTISCTGSGGSIDNNYVHWYQQRPGSAPTTVMFEDNQRPSGVPDRFSGSIDSSSNSASLVISGLKTEDEGDYYCQSSDGSKVVFGGGTKLTVLGQGGGGSGGGGSGGGGSEVQLVQSGGGSLTLSCAASGVVQPGRFTFSSYGMHWVRQAPGKGLEWVSVISYDGSNKYYADSVKGRFTISRDNSKNTLYLQMNSLRTEDTAVYYCAKTLSAGEWIGGGAFDIWGHGTMVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6268 - protein, 1098 aa, Artificial Sequence
  Synthetic Polypeptide encoding a CAR with optional accessory module(s)
MALPVTALLLPLALLLHAARPDVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQNTPVPPKFGSGTKLEIKGGGGSGGGGSGGGGSQVQLQQSGAELVRPGASVKLSCKASGYTFNDYEMHWVKQTPVHGLKWIGALEPKTGDTAYSQKFKGKATLTADKSSSTAYMELRSLTSEDSAVYYCTSCYYYTYSGQGTLVTVSATRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6269 - protein, 1097 aa, Artificial Sequence
  Synthetic Polypeptide encoding a CAR with optional accessory module(s)
MALPVTALLLPLALLLHAARPDIQLTQSPSSLSASVGDRVTITCRASQGIRNDLGWYQQKPGKAPKRLIYAASSLQNGVPSRFSGSGSGTEFTLTISSLQPEDFATYYCLQHNTYPAFGQGTKVEIKRGGGGSGGGGSGGGGSQVQLQESGPGLVKPSQTLSLTCTVSGGSISSFNYYWSWIRHHPGKGLEWIGYIYYSGSTYSNPSLKSRVTISVDTSKNQFSLTLSSVTAADTAVYYCARGYNWNYFDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6270 - protein, 1099 aa, Artificial Sequence
  Synthetic Polypeptide encoding a CAR with optional accessory module(s)
MALPVTALLLPLALLLHAARPDDIVLTQSPASLAVSLGQSVTISCRASESVEYYGTSLMQWYQQKPGQPPKLLIYATSNVESGVPARFSGSGSGTDFSLNIHPVEEDDIAMYFCQQSRKLPSTFGGGTKLEIKGGGGSGGGGSGGGGSDVRLQESGPGQVKPSQTVSLTCSVTGYSITNGNHWWNWIRQVSGSKLEWIGYISSSGSTDSNPSLKSRISITRDTSKNQLFLQLNSVTTEDIATYYCARGYYFDYWGQGTTLTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6271 - protein, 977 aa, Artificial Sequence
  Synthetic Polypeptide encoding a CAR with optional accessory module(s)
MALPVTALLLPLALLLHAARPDEFEVQLVESGGGLVQAGGSLRLSCAASGITFSINTMGWYRQAPGKQRELVALISSIGDTYYADSVKGRFTISRDNAKNTVYLQMNSLKPEDTAVYYCKRFRTAAQGTDYWGQGTQVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6272 - protein, 912 aa, Artificial Sequence
  Synthetic Polypeptide encoding a CAR with optional accessory module(s)
MDWIWRILFLVGAATGAHSFEGSGFEYAKEMRNAYWEIALLPNLTNQQKRAPIRKLYDDPSQSSELLSEAKKLNDSQTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6273 - protein, 983 aa, Artificial Sequence
  Synthetic Polypeptide encoding a CAR with optional accessory module(s)
MALPVTALLLPLALLLHAARPDEFGSDLGIKLLFAAAKGQDDEVRILLAAGADVNAKDFEGYTPLHVAAYDGHLEIVEVLLKAGADVNAKDSQGRTPLHEAAYSGHLEIVEVLLKAGADVNAQDDAGETPADLAAAWGHEDIAEVLQKTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6274 - protein, 982 aa, Artificial Sequence
  Synthetic Polypeptide encoding a CAR with optional accessory module(s)
MDWIWRILFLVGAATGAHSFERSDLGKKLLEAARAGQDDEVRILMANGADVNAKDEYGLTPLYLATAHGHLEIVEVLLKNGADVNAVDAIGFTPLHLAAFIGHLEIAEVLLKHGADVNAQDKFGKTAFDISIGNGNEDLAEILQKLNTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6275 - protein, 1134 aa, Artificial Sequence
  Synthetic Polypeptide encoding a CAR with optional accessory module(s)
MALPVTALLLPLALLLHAARPDEFEVQLVESGGGLVQAGGSLRLSCAASGITFSINTMGWYRQAPGKQRELVALISSIGDTYYADSVKGRFTISRDNAKNTVYLQMNSLKPEDTAVYYCKRFRTAAQGTDYWGQGTQVTVSSLEGGGGSGGGGSGGGGSGSGGSGSGGSGSGGSGSGGSFEVQLVESGGGLVQPGGSLRLSCAASGSIFGFNDMAWYRQAPGKQRELVALISRVGVTSSADSVKGRFTISRVNAKDTVYLQMNSLKPEDTAVYYCYMDQRLDGSTLAYWGQGTQVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6276 - protein, 1098 aa, Artificial Sequence
  Synthetic Polypeptide encoding a CAR with optional accessory module(s)
MALPVTALLLPLALLLHAARPDIQMTQSPSSLSASVGDRVTITCRASQDVNTAVAWYQQKPGKAPKLLIYSASFLESGVPSRFSGSRSGTDFTLTISSLQPEDFATYYCQQHYTTPPTFGQTKVEIKRGGGGSGGGGSGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDVWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6277 - protein, 977 aa, Artificial Sequence
  Synthetic Polypeptide encoding a CAR with optional accessory module(s)
MALPVTALLLPLALLLHAARPDEFDVQLVESGGGLVQPGGSLRLSCAASGSIGGLNAMAWYRQAPGKERELVAGIFGVGSTRYADSVKGRFTISRDNSKNTVYLQMNSLRPEDTAVYYCRMSSVTRGSSDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6278 - protein, 917 aa, Artificial Sequence
  Synthetic Polypeptide encoding a CAR with optional accessory module(s)
MALPVTALLLPLALLLHAARPDEFVDNKFNKERYSAYYEIWQLPNLNVRQKAAFIGSLQDDPSQSANLLAEAKKLNDAQAPKTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6279 - protein, 1139 aa, Artificial Sequence
  Synthetic Polypeptide encoding a CAR with optional accessory module(s)
MALPVTALLLPLALLLHAARPDEFDVQLVESGGGLVQPGGSLRLSCAASGSIGGLNAMAWYRQAPGKERELVAGIFGVGSTRYADSVKGRFTISRDNSKNTVYLQMNSLRPEDTAVYYCRMSSVTRGSSDYWGQGTLVTVSSLEGGGGSGGGGSGGGGSGSGGSGSGGSGSGGSGSGGSFEVQLVESGGSLVQPGGSLRLSCAASGFTFDDYAMSWVRQVPGKGLEWVSSINWSGTHTDYADSVKGRFTISRNNANNTLYLQMNSLKSEDTAVYYCAKNWRDAGTTWFEKSGSAGQGTQVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6280 - protein, 1097 aa, Artificial Sequence
  Synthetic Polypeptide encoding a CAR with optional accessory module(s)
MALPVTALLLPLALLLHAARPDQSVLTQPPSVSVAPGKTARIPCEGNYIGSSNVHWYQQKPGQAPVLVIHFDSDRPSGIPDRFSGSNSGNMATLTISRVEAGDEADYYCQVWENHGWVFGGGTKLTVLSGGGGSGGGGSGGGGSEVQLVETGGGLVQPGESLRLSCAASGFTFSDYEMNWVRQAPGKGLEWVSYISSSGSTIYYADSVKGRFTIYRDNAKNSLYLQMNSLRAEDTALYYCARAWGVGPPDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6281 - protein, 1105 aa, Artificial Sequence
  Synthetic Polypeptide encoding a CAR with optional accessory module(s)
MALPVTALLLPLALLLHAARPDIQMTQSPSSLSASVGDTVTITCQANGYLNWYQQRRGKAPKLLIYDGSKLERGVPSRFSGRRWGQEYNLTINNLQPEDIATYFCQVYEFVVPGTRLDLKRTVAAPGGGGSGGGGSGGGGSQVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVSSASTKGPTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6282 - protein, 1111 aa, Artificial Sequence
  Synthetic Polypeptide encoding a CAR with optional accessory module(s)
MALPVTALLLPLALLLHAARPQSALTQPPSASGSPGQSITISCTGTSNNFVSWYQQHAGKAPKLVIYDVNKRPSGVPDRFSGSKSGNTASLTVSGLQTDDEAVYYCGSLVGNWDVIFGGGTKLTVLGGGGSGGGGSGGGGSQPQLQESGPTLVEASETLSLTCAVSGDSTAACNSFWGWVRQPPGKGLEWVGSLSHCASYWNRGWTYHNPSLKSRLTLALDTPKNLVFLKLNSVTAADTATYYCARFGGEVLRYTDWPKPAWVDLWGRGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6283 - protein, 1096 aa, Artificial Sequence
  Synthetic Polypeptide encoding a CAR with optional accessory module(s)
MALPVTALLLPLALLLHAARPEIVLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIKRGGGGSGGGGSGGGGSQVQLVQSGGQMKKPGESMRISCRASGYEFIDCTLNWIRLAPGKRPEWMGWLKPRGGAVNYARPLQGRVTMTRDVYSDTAFLELRSLTVDDTAVYFCTRGKNCDYNWDFEHWGRGTPVIVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6284 - protein, 1106 aa, Artificial Sequence
  Synthetic Polypeptide encoding a CAR with optional accessory module(s)
MALPVTALLLPLALLLHAARPELVLTQSPGTLSLSAGERATLSCRASQSVSSGSLAWYQQKPGQAPRLLIYGASTRATGIPDRFSGSGSGTDFTLTIGRLEPEDLAVYYCQQYGTSPYTFGQGTKLEIGGGGSGGGGSGGGGSLEQSGAEVKKPGSSVQVSCKASGGTFSMYGFNWVRQAPGHGLEWMGGIIPIFGTSNYAQKFRGRVTFTADQATSTAYMELTNLRSDDTAVYYCARDFGPDWEDGDSYDGSGRGFFDFWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6285 - protein, 1102 aa, Artificial Sequence
  Synthetic Polypeptide encoding a CAR with optional accessory module(s)
MALPVTALLLPLALLLHAARPDVVMTQSPSSLSASVGDRVTITCQSSLDISHYLNWYQQKPGKAPKLLIYDASNLETGVPSRFSGSGSGTHFTFTISSLQPEDFATYYCQQYDNLPLTFGGGTKLEIKRGGGGSGGGGSGGGGSQVQLVQSGGGVVQPGGSLRVSCAASGVTLSDYGMHWVRQAPGKGLEWVAFIRNDGSDKYYADSVKGRFTISRDNSEKTVSLQMSSLRAEDTAVYYCAKNGESGPLDYWYLDLWGRGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6286 - protein, 1102 aa, Artificial Sequence
  Synthetic Polypeptide encoding a CAR with optional accessory module(s)
MALPVTALLLPLALLLHAARPDDIVMTQSQDSMATSVGERVTVNCKASQNVDTNVAWYQQKPGQSPEPLLFSASYRYTGVPDRFSGSGSGTDFTLTISSVQAEDVAEYFCQQYNSYPLTFGQGTKLEIKRGGGGSGGGGSGGGGSEVQVEVSGGGLVQPGGSMRLSCAVSGFTFSNYWMNWVRQSPEKGLEWIAEIRLKSNNFARYYAESVKGRFTISRDNSKNSLYLQMISLRAEDTAIYYCTSYGNYVGHYFDHWGQGTLLTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6287 - protein, 1106 aa, Artificial Sequence
  Synthetic Polypeptide encoding a CAR with optional accessory module(s)
MALPVTALLLPLALLLHAARPSYELTQPPSVSGTPGQRVAISCSGSSSNIGTRMVTWYQHVPGTAPKLLIFNNNQRPSGVPDRFSASKSGTSASLAIIGLQSDDEADYYCATWDDNVKSYVFGTGTKVTVLGSRGGGGSGGGGSGGGGSLEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARAPQSWYVGDVWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6288 - protein, 1103 aa, Artificial Sequence
  Synthetic Polypeptide encoding a CAR with optional accessory module(s)
MALPVTALLLPLALLLHAARPQSVLTQPPSLSVAPGKTASITCGGNNIGMKSVHWYQQRPGQAPVLVIYYDSDRPSGIPGRFSGSNSGNTATLTISRVEAGDEADYYCQVWDTTGDHPGYVFGTGTKVTVLGGGGSGGGGSGGGGSQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGVYGYSGSAPYDEWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6289 - protein, 1109 aa, Artificial Sequence
  Synthetic Polypeptide encoding a CAR with optional accessory module(s)
MALPVTALLLPLALLLHAARPDEIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPRTFGQGTKVEIKRGGGGSGGGGSGGGGSQVQLVQSGGGVVQPGRSLRLSCAASGFTFSSYGMHWVRQAPGKGLEWVAVISYDGSNKYYADSVKGRFTISRDNSKNTLYLQMNSLRAEDTAVYYCARDFDYGDSYYYYGMDVWGQGTTVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6290 - protein, 1103 aa, Artificial Sequence
  Synthetic Polypeptide encoding a CAR with optional accessory module(s)
MALPVTALLLPLALLLHAARPDEIVLTQSPATLSLSPGERATLSCRASQSVGSYLAWYQQKPGAPRLLIYDASHRATGIPARFSGSGSGTDFTLTISSLEPEDFAVYYCQQRSNWPPMYTFGQGTKLEIKRGGGGSGGGGSGGGGSEVQLVQSGAEVSVKVSCKASGGKKPGSTFSSYTISWVRQAPGQGLEWMGGIIPIFGTANYAQKFQGRVTITADKSTSTAYMELSSLRSEDTAVYYCAGDTDSSGYYGAVDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6291 - protein, 1086 aa, Artificial Sequence
  Synthetic Polypeptide encoding a CAR with optional accessory module(s)
MALPVTALLLPLALLLHAARPDIQMTQSPSSLSASVGDRVTITCQASQDINNYLNWYQQKPGKAPKLLIYDASNLQTGVPSRFSGSGSGTDFTFTIEDIATYYCQQYTFGPGTKVDIKGGGGSGGGGSGGGGSEVQLLESGGGLVQPGGSLRLSCAASGFTFSWYSMTWVRQAPGKGLEWVSSIVPWGDFTQYADSVKGRFTISRDNSKNTLYLQMNSLRAEDTAVYYCAKGPGWGSFDLWGRGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6292 - protein, 975 aa, Artificial Sequence
  Synthetic Polypeptide encoding a CAR with optional accessory module(s)
MDWIWRILFLVGAATGAHSEVQLVESGGGLVQPGGSLRLSCAASGSVFKINVMAWYRQAPGKGRELVAGIISGGSTSYADSVKGRFTISRDNAKNTLYLQMNSLRPEDTAVYYCAFITTESDYDLGRRYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6293 - protein, 1096 aa, Artificial Sequence
  Synthetic Polypeptide encoding a CAR with optional accessory module(s)
MALPVTALLLPLALLLHAARPDIQMTQSPSSLSASVGDRVTITCTASLSVSSTYLHWYQQKPGSSPKLWIYSTSNLASGVPSRFSGSGSGTSYTLTISSLQPEDFATYYCHQYHRSPLTFGGGTKVEIKRGGGGSGGGGSGGGGSEVQLVESGGGLVQPGGSLRLSCAASGFSLTKYGVHWVRQAPGKGLEWVGVKWAGGSTDYNSALMSRFTISKDNAKNSLYLQMNSLRAEDTAVYYCARDHRDAMDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6294 - protein, 1100 aa, Artificial Sequence
  Synthetic Polypeptide encoding a CAR with optional accessory module(s)
MALPVTALLLPLALLLHAARPDIQMTQSPSSLSASVGDRVTITCKASQDVGTAVAWYQQKPGKAPKLLIYSASYRSTGVPSRFSGSGSGTDFTLTISSLQPEDFATYYCQHHYSAPWTFGGGTKVEIKGGGGSGGGGSGGGGSEVQLVESGGGLVQPGGSLRLSCAASGFTFSRNGMSWVRQAPGKGLEWVATVSSGGSYIYYADSVKGRFTISRDNAKNSLYLQMNSLRAEDTAVYYCARQGTTALATRFFDVWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6295 - protein, 1106 aa, Artificial Sequence
  Synthetic Polypeptide encoding a CAR with optional accessory module(s)
MALPVTALLLPLALLLHAARPDIVMTQSPSSLTMSVGQKVTMSCKSSHSLLNSRNQKNYLAWFQQKPGQSPKLLVYFASTRESGVPDRFIGSGSGTDFTLTISNVQAEDLADYFCQQHYTTLPTFGGGTKLEIKGGGGSGGGGSGGGGSQIQLVQSGPDLKKPGETVKISCKASGYTFTNTGMNWVKQAPGKGLKWMGWINTYTGEPTYADDFKGRFTFSLETSASTAYLQINNLKNEDTATYFCTRWGYGSSLYYAMDYWGQGTSVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6296 - protein, 1096 aa, Artificial Sequence
  Synthetic Polypeptide encoding a CAR with optional accessory module(s)
MALPVTALLLPLALLLHAARPDIQMTQSPPSLSASVGGKVTITCKASQDIDRYMAWYQDKPGKGPKLLIHDTSTLQPGIPSRFSGSGSGRDYSFSISNLEPEDIATYYCLQYDNLWTFGGGTKLEIKRGGGGSGGGGSGGGGSQVQLVQSGAELVKPGASVKMSCKASGYIFTNYNIHWVKKSPGQGLEWIGAIYPGNGDAPYSQKFQDRATLTADTSSSTTYMELSSLTSEDSAVYYCVRANWDVAFAYWGQGTLVSVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6297 - protein, 1097 aa, Artificial Sequence
  Synthetic Polypeptide encoding a CAR with optional accessory module(s)
MALPVTALLLPLALLLHAARPDIQMTQSPASLSASVGETVTITCRVSGNIHNYLAWYQQKQGKSPQLLVYNAKTLADGVPSRFSGSGSGTQYSLKINSLQPEDFGSYYCQHFWSNPYTFGGGTKLEIKGGGGSGGGGSGGGGSQVQLQQSGASVKVSCKASELVRPGTGYAFTNYLIEWVKQRPGQGLEWIGVINPGSGGTNYNEKFKGKATLTADKSSSTAYMQLSSLTSDDSAVYFCARYRSYDWYFDVWGAGTTVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6298 - protein, 1102 aa, Artificial Sequence
  Synthetic Polypeptide encoding a CAR with optional accessory module(s)
MALPVTALLLPLALLLHAARPDDIQMTQSPSSLSASVGDRVTITCRSSQRIVHSNGNTYLEWYQQTPGKAPKLLIYKVSNRFSGVPSRFSGSGSGTDYTPTISSLQPEDIATYYCFQGSHVPPTFGQGTKLQITGGGGSGGGGSGGGGSEVQLVESGGGVVQPGRSLRLSCSSSGPTFSDYYMYWVRQAPGKGLEWVAYMSNVGAITDYPDTVKGRPTISRDNSKNTLFLMDSLRPEDTGVYFCARGTRDGSWFAYWGQGTPVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6299 - protein, 1096 aa, Artificial Sequence
  Synthetic Polypeptide encoding a CAR with optional accessory module(s)
MALPVTALLLPLALLLHAARPDIQMTQSFSSLSASVGDRVTITCRASQDISNYLNWYQQKPGKAPKLLIYYTSRLHSGVPSRFSGSGSGTDYTLTISSLQPEDFATYFCQQGNTLPWTFGGGTKLEIKRGGGGSGGGGSGGGGSEVQLVQSGGGLVQSGGSLRLSCRASGYTFTRYWMLWVRQRPGKGLEWVAEINPRNDRTNYNEKFKTRFTISVDRSKNTLYLQMDSLRAEDTAVYFCALGGGYAMDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6300 - protein, 1083 aa, Artificial Sequence
  Synthetic Polypeptide encoding a CAR with optional accessory module(s)
MEMLQGLLLLLLLSMGGAWASREPLRPWCHPINAILAVEKEGCPVCITVNTTICAGYCPTMMRVLQAVLPPLPQVVCTYRDVRFESIRLPGCPRGVDPVVSFPVALSCRCGPCRRSTSDCGGPKDHPLTCDHPQLSGLLFLGGGGSGGGGSGGGGSAPDVQDCPECTLQENPFFSQPGAPILQCMGCCFSRAYPTPLRSKKTMLVQKNVTSESTCCVAKSYNRVTVMGGFKVENHTACHCSTCYYHKSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6301 - protein, 1097 aa, Artificial Sequence
  Synthetic Polypeptide encoding a CAR with optional accessory module(s)
MALPVTALLLPLALLLHAARPDIQMTQSPASLSASVGETVTIICRASVNIYSYLAWYQQKQGKSPQLLVYNAKILAEGVPSRFSGSGSGTQFSLKINSLQPEDFGSYYCQHHYGTFTFGSGTKLEIKRGGGGSGGGGSGGGGSQVQLKESGPGLVAPSQSLSITCTISGFSLTSYGVHWVRQPPGKGLEWLVVIWSDGSTTYNSALKSRLSISKDNSKSQVFLKMNSLQTDDTAIYYCASHYGSTLAFASWGHGTLVTVSAATRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6302 - protein, 1105 aa, Artificial Sequence
  Synthetic Polypeptide encoding a CAR with optional accessory module(s)
MALPVTALLLPLALLLHAARPDIVMTQSHKFMSTSVGDRVSVTCKASQNVGNNVAWYQQKPGQSPKVLIYSASYRYSGVPDRFTGSGSGTDFTLTISNVQSEDLAEYFCQQYNTYPFTFGSGTKLEIKGGGGSGGGGSGGGGSEVQLEESGGGLVQPGGSMKLSCVASGFTFSNYWMNWVRQSPEKGLEWVAEIRFKSHNYATHFAESVKGRFTISRDDSKSSVYLQMNNLRAEDTGIYYCTRRIGNSDYDWWYFDVWGAGTSVTVSSASTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6303 - protein, 1101 aa, Artificial Sequence; identical to SEQ ID NO: 6188
  Synthetic Polypeptide encoding a CAR with optional accessory module(s)

SEQ ID NO: 6304 - protein, 1107 aa, Artificial Sequence
  Synthetic Polypeptide encoding a CAR with optional accessory module(s)
MALPVTALLLPLALLLHAARPDQSVLTQPPSVSGAPGQRVTISCTGSSSNIGAGYDVHWYQQLPGTAPKLLIYGNSNRPSGVPDRFSGSKSGTSASLAITGLQAEDEADYYCQSYDNSLSSWVFGGGTKLTVLGQPKGGGGSGGGGSGGGGSEVQLQQSGAEVKKPGSSVKVSCKASGGTFSSYAISWVRQAPGQGLEWMGRIIPILGIANYAQKFQGRVTITADKSTSTAYMELSSLRSEDTAVYYCARDVGSGSYSLDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6305 - protein, 1104 aa, Artificial Sequence
  Synthetic Polypeptide encoding a CAR with optional accessory module(s)
MALPVTALLLPLALLLHAARPDQSVVTQPPSVSAAPGRKVTISCSGSSSNIGSNYVSWYQQVPGTAPKLLIYEDDKRPSGIPDRFSGSKSGTSATLGITGLQTGDEADYFCATWDRTVNVVRFGGGTRLTVHSQPKGGGGSGGGGSGGGGSQLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARHVGHELDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6306 - protein, 1098 aa, Artificial Sequence
  Synthetic Polypeptide encoding a CAR with optional accessory module(s)
MALPVTALLLPLALLLHAARPDIQMTQSPSSLSASVGDRVTITCRASQSISSYLNWYQQKPGKAPKLLIYAASSLQSGVPSGFSGSGSGTDFTLTISSLQPEDFATYYCQQSYSTPLTFGGGTKVEIKRGGGGSGGGGSGGGGSQVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCAREGKNGAFDIWGQGTMVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6307 - protein, 984 aa, Artificial Sequence
  Synthetic Polypeptide encoding a CAR with optional accessory module(s)
MALPVTALLLPLALLLHAARPDEFDVQLVESGGGLVQPGGSLRLSCAASGFILDYYAIGWFRQAPGKEREGVLCIDASDDITYYADSVKGRFTISRDNSKNTVYLQMNSLRPEDTAVYYCATPIGLSSSCLLEYDYDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6308 - protein, 1147 aa, Artificial Sequence
  Synthetic Polypeptide encoding a CAR with optional accessory module(s)
MALPVTALLLPLALLLHAARPDEFDVQLVESGGGLVQPGGSLRLSCAASGFILDYYAIGWFRQAPGKEREGVLCIDASDDITYYADSVKGRFTISRDNSKNTVYLQMNSLRPEDTAVYYCATPIGLSSSCLLEYDYDYWGQGTLVTVSSLEGGSGSGGGGSGGGGSGSGGSGSGGSGSGGSGSGGSFEVQLVESGGGLVQPGGSLRLSCAASGRTYYLNAMGWFRQAPGKEREFVAAIDWSEGNKDYADSVKGRFTISRDNSKNTVYLQMNSLRPEDTAVYYCAADTPPWGPLIYIESYDSWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6309 - protein, 1098 aa, Artificial Sequence
  Synthetic Polypeptide encoding a CAR with optional accessory module(s)
MALPVTALLLPLALLLHAARPDQIVLTQSPAIMSASPGEKVTISCSASSSVSYMYWYQQKPGSSPKPWIYRTSNLASGVPARFSGSGSGTSYSLTISNMEAEDAAAYYCQQYHSYPTTFGGGTKLEVKGGGGSGGGGSGGGGSEVQLVESGGGLVQPKGSLKLSCAASGFSFNTYAMNWVRQAPGKGLEWIAHIRSKSNNFATYYADSVKDRFSISRDASENILFLQMNNLKTEDTAMYYCVRQGGDFPMDYWGQGTSVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6310 - protein, 1097 aa, Artificial Sequence
  Synthetic Polypeptide encoding a CAR with optional accessory module(s)
MALPVTALLLPLALLLHAARPDDIQMTQSSSSFSVSLGDRVTITCMASEDIYIRLAWYQQKPGNAPRLLISAATSLETGVPSRFSGSGSGKDYTLSITSLQTEDVGTYYCQQYWSSPWTFGGGTKLEINGGGGSGGGGSGGGGSDVQLQESGPGLVKPSQSLSLTCTVTGYSITSDYTWNWIRQFPGNKLEWMGYITYSGSTSYNPSLKSRNSITRDTSKNQFFLQLNSVTTEDTATYYCARLGRRYTMDYWGQGTSVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6311 - protein, 1096 aa, Artificial Sequence
  Synthetic Polypeptide encoding a CAR with optional accessory module(s)
MALPVTALLLPLALLLHAARPDVQLQESGPGLVKPSQSLSLTCTVTGYSITSDYTWNWIRQFPGNKLEWMGYITYSGSTSYNPSLKSRNSITRDTSKNQFFLQLNSVTTEDTATYYCARLGRRYTMDYWGQGTSVTVSSGGGGSGGGGSGGGGSDIQMTQSSSSFSVSLGDRVTITCMASEDIYIRLAWYQQKPGNAPRLLISAATSLETGVPSRFSGSGSGKDYTLSITSLQTEDVGTYYCQQYWSSPWTFGGGTKLEINTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6312 - protein, 1097 aa, Artificial Sequence
  Synthetic Polypeptide encoding a CAR with optional accessory module(s)
MALPVTALLLPLALLLHAARPDIQMTQSSSSFSVSLGDRVTITCKASEDIYIRLAWYQQKPGNAPRLLISAATSLETGIPSRFSGSGSGEDYTLTITSLQTEDVATYYCQQYWTTPWTFGGGTKLEIKRGGGGSGGGGSGGGGSDVQLQESGPGLVKPSQSLSLTCTVTGYSITIDYTWNWIRQFPGNKLEWMGYITYSGSTDYNPSLKSRSSITRDTSMNQFFLQLNSVTTEDTATYYCARLGRRYALDYWGQGTSVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6313 - protein, 1098 aa, Artificial Sequence
  Synthetic Polypeptide encoding a CAR with optional accessory module(s)
MALPVTALLLPLALLLHAARPDIVMTQAAPSIPVTPGESVSISCRSDKSLLHSNGNTYLFWFLQRPGQSPQLLIYRMSNLASGVPDRFSGSGSGTAFTLRISGVEAEDVGVYYCMQHLEYPYTFGGGTKLEIKGGGGSGGGGSGGGGSQVQLQQSGPELVKPGASVKMSCKASGYAFSSSWLNWVRQRPGKGLEWIGRIYPGDGENHYNGKFKGKATLTADKSSSTGYMQLSSLTSEDSAVYFCASYYEGGYWGQGTLITVSATRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6314 - protein, 1097 aa, Artificial Sequence
  Synthetic Polypeptide encoding a CAR with optional accessory module(s)
MALPVTALLLPLALLLHAARPDIVLTQSPASLAVSLGQSVTISCRASESVEYYGTSLMQWYQQKPGQPPKLLIYGASNVESGVPARFSGSGSGTDFSLNIHPVEEDDIAMYFCQQSRKVPWTFGGGTKLEIKGGGGSGGGGSGGGGSEVKLVESGGGLVKPGGSRKLSCAASGFTFSSYTMSWVRQTPAKRLEWVATISSGSSTIYYADTVKGRFTISRDNAKNTLFLQMTSLRSEDTAMYYCARRWFLDCWGQGTTLTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6315 - protein, 1100 aa, Artificial Sequence
  Synthetic Polypeptide encoding a CAR with optional accessory module(s)
MALPVTALLLPLALLLHAARPDQVQLQQSGPGLVKPSETLSLTCTVSGDSISSYYWSWIRQPPGKGLEWIGYIYYSGSTNYNPSLKSRVTISVDTSKSQFSLKLSSVTAADTAVYYCARGRYFDVWGRGTMVTSSGGGGSGGGGSGGGGSSSYVLTQPPSVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLGAAATRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6316 - protein, 1101 aa, Artificial Sequence
  Synthetic Polypeptide encoding a CAR with optional accessory module(s)
MALPVTALLLPLALLLHAARPDIVMTQSPLSLPVTPGEPASISCRSSKSLLHSNGNTYLYWFQQKPGQAPRLLIYRMSNLASGVPDRFSGSGSGTAFTLKISRVEAEDVGVYYCMQHIEYPFTFGQGTKLEIKGGGGSGGGGSGGGGSQVQLVQSGPEVKKPGASVKVSCKASGYTFTNSWMNWVRQRPGKGLEWIGRIYPGDGETIYNGKFRVRVTITADESTSTAYMELSSLRSEDTAVYYCARGYDDYSFAYWGQGTTVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6317 - protein, 1101 aa, Artificial Sequence
  Synthetic Polypeptide encoding a CAR with optional accessory module(s)
MALPVTALLLPLALLLHAARPDEIVMTQSPATLSLSPGERATLSCRASQSVSSYLAWYQQKPGQAPRLLIYDASNRATGIPARFSGSGSGTDFTLTISSLEPEDFAVYYCHQYGSSPQTFGQGTKVEIKRGGGGSGGGGSGGGGSEVQLVQSGAEVKKPGSSVKVSCKASGGTFSSYAISWVRQAPGQGLEWMGGIIPIFGTANYAQKFQGRVTITADESTSTAYMELSSLRSEDTAVYYCAVHYGDYVFSSMDVWGQGTTVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6318 - protein, 1104 aa, Artificial Sequence
  Synthetic Polypeptide encoding a CAR with optional accessory module(s)
MALPVTALLLPLALLLHAARPDETTLTQSPGTLSLSPGERATLSCRASQSVSSSYLAWYQQKPGQAPRLLIYGASSRATGIPDRFSGSGSGTDFTLTISRLEPEDFAVYYCQQYGSSPRTFGQGTKVEIKRGGGGSGGGGSGGGGSEVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGPEYCINGVCSLDVWGQGTTVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6319 - protein, 1106 aa, Artificial Sequence
  Synthetic Polypeptide encoding a CAR with optional accessory module(s)
MALPVTALLLPLALLLHAARPDIELTQSPSSLAVSAGEKVTMSCKSSQSLLNSRTRKNQLAWYQQKPGQSPELLIYWASTRQSGVPDRFTGSGSGTDFTLTISSVQAEDLAVYYCQQSYNLLTFGPGTKLEVKRGGGGSGGGGSGGGGSVKLQESGGGFVKPGGSLKVSCAASGFTFSSYAMSWVRLSPEMRLEWVATISSAGGYIFYSDSVQGRFTISRDNAKNTLHLQMGSLRSGDTAMYYCARQGFGNYGDYYAMDYWGQGTTVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6320 - protein, 1105 aa, Artificial Sequence
  Synthetic Polypeptide encoding a CAR with optional accessory module(s)
MALPVTALLLPLALLLHAARPDIQMTQSPSSLSASVGDRVTITCRSSQNIVHSNGNTYLDWYQQTPGKAPKLLIYKVSNRFSGVPSRFSGSGSGTDFTFTISSLQPEDIATYYCFQYSHVPWTFGQGTKLQIGGGGSGGGGSGGGGSQVQLQQSGAEVKKPGSSVKVSCKASGYTFTNYYIYWVRQAPGQGLEWIGGINPTSGGSNFNEKFKTRVTITADESSTTAYMELSSLRSEDTAFYFCTRQGLWFDSDGRGFDFWGQGTTVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6321 - protein, 1001 aa, Artificial Sequence
  Synthetic Polypeptide encoding a CAR with optional accessory module(s)
MALPVTALLLPLALLLHAARPLFNQEVQIPLTESYCGPCPKNWICYKNNCYQFFDESKNWYESQASCMSQNASLLKVYSKEDQDLLKLVKSYHWMGLVHIPTNGSWQWEDGSILSPNLLTIIEMQKGDCALYASSFKGYIENCSTPNTYICMQRTVGGGGSGGGGDTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6322 - protein, 1095 aa, Artificial Sequence
  Synthetic Polypeptide encoding a CAR with optional accessory module(s)
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIKRGGGGSGGGGSGGGGSQVHLQESGPGLVKPSETLSLTCTVSDDSISSYYWSWIRQPPGKGLEWIGHISYSGSANYNPSLKSRVTISVDTSKNQFSLKLSSVTAADTAVYYCANWDDAFNIWGQGTMVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6323 - protein, 1097 aa, Artificial Sequence
  Synthetic Polypeptide encoding a CAR with optional accessory module(s)
MALPVTALLLPLALLLHAARPDVVMTQTPLTLSVTIGQPASISCKSSQSLLDSDGKTYLHWLLQRPGQSPKRLIFLVSKLDSGVPDRFTGSGSGTDFTLKISRVEAEDLGVYYCWQGTHFPQTFGGGTKLEIKGGGGSGGGGSGGGGSVQLQESGPDLVKPSQSLSLTCTVTGYSITSGYSWHWIRQFPGNKLEWMGYIHYSGDTDYNPSLKSRFSITRDTSKNQFFLQLNSVTTEDTATYYCATPGGFVYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6324 - protein, 1101 aa, Artificial Sequence
  Synthetic Polypeptide encoding a CAR with optional accessory module(s)
MALPVTALLLPLALLLHAARPDQSELTQPRSVSGSPGQSVTISCTGTERDVGGYNYVSWYQQHPGKAPKLIIHDVIERSSGVPDRFSGSKSGNTASLTISGLQAEDEADYYCWSFAGGYYVFGTGTDVTVLGGGGSGGGGSGGGGSFEVQLLESGGGLVQPGGSLRLSCAASGFTFSTYQMSWVRQAPGKGLEWVSGIVSSGGSTAYADSVKGRFTISRDNSKNTLYLQMNSLRAEDTAVYYCAGELLPYYGMDVWGQGTTVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6325 - protein, 1100 aa, Artificial Sequence
  Synthetic Polypeptide encoding a CAR with optional accessory module(s)
MALPVTALLLPLALLLHAARPDQSELTQPRSVSGSPGQSVTISCTGTERDVGGYNYVSWYQQHPGKAPKLIIHDVIERSSGVPDRFSGSKSGNTASLTISGLQAEDEADYYCWSFAGGYYVFGTGTDVTVLGGGGSGGGGSGGGGSEVQLLESGGGLVQPGGSLRLSCAASGFTFSTYEMHWVRQAPGKGLEWVSVILSSGGETNYADSVKGRFTISRDNSKNTLYLQMNSLRAEDTAVYYCAGMLLPYYGMDVWGQGTTVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6326 - protein, 1002 aa, Artificial Sequence
  Synthetic Polypeptide encoding a CAR with optional accessory module(s)
MALPVTALLLPLALLLHAARPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6327 - protein, 1097 aa, Artificial Sequence
  Synthetic Polypeptide encoding a CAR with optional accessory module(s)
MALPVTALLLPLALLLHAARPDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRGGGGSGGGGSGGGGSEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6328 - protein, 1098 aa, Artificial Sequence
  Synthetic Polypeptide encoding a CAR with optional accessory module(s)
MALPVTALLLPLALLLHAARPAIVMTQTPSPVSAAVGGTVTINCQASESVYSNNYLSWFQQKPGQPPKLLIYLASTLASGVPSRFKGSGSGTQFTLTISGVQCDDAATYYCIGGKSSSTDGNAFGGGTEVVVRGGGGSGGGGSGGGGSQSLEESGGRLVKPDETLTITCTVSGIDLSSNGLTWVRQAPGEGLEWIGTINKDASAYYASWAKGRLTISKPSSTKVDLKITSPTTEDTATYFCGRIAFKTGTSIWGPGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6329 - protein, 1096 aa, Artificial Sequence
  Synthetic Polypeptide encoding a CAR with optional accessory module(s)
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSGGGGSGGGGSQVQLVQSGAEVKKPGASVKVSCKASGYTFTSYDVHWVRQAPGQRLEWMGWLHADTGITKFSQKFQGRVTITRDTSASTAYMELSSLRSEDTAVYYCARERIQLWFDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6330 - protein, 1115 aa, Artificial Sequence
  Synthetic Polypeptide encoding a CAR with optional accessory module(s)
MALPVTALLLPLALLLHAARPDDIVMTQSPLSLPVTPGEPASISCRSSQSLLHSNGYNYLVWYLQKPGQSPQLLIYLGSIRASGVPDRFSGSGSGTDFTLKISRVEAEDVGVYYCMQPLQTPITFGQGTRLEIKRGGGGSGGGGSGGGGSGLQCVAAPRWVLSQVQLQQWGAGLLKPSETLSLTCAVYGGSFSGNYWSWIRQPPGKGLEWIGEINHSGSTNYNPSLKSRVTISVDTSKNQFSLKLSSVTAADTAVYYCARGGSYNYFDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6331 - protein, 1112 aa, Artificial Sequence
  Synthetic Polypeptide encoding a CAR with optional accessory module(s)
MALPVTALLLPLALLLHAARPDQLTQSPSSVSASVGDRVTITCRASRGISSWLAWYQQKPGKAPKLLIYTASSLQSGVPSRFSGSGSGTDFTLTISSLQPEDFATYYCQQAYSFPRTFGQGTKVEIKRGGGGSGGGGSGGGGSVAAPRWVLSQVQLQESGPGLVKPSQTLSLTCTVSGGSISSGGYYWIWIRQHPGKGLEWIGYIYYNGNTYYNPSLKSRVTMSVDTSKNQFSLKLSSVTAADTAVYYCARDGITMIRGYYYGMDVWGQGTTVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6332 - protein, 1086 aa, Artificial Sequence
  Synthetic Polypeptide encoding a CAR with optional accessory module(s)
MALPVTALLLPLALLLHAARPDIVVTQSPASLAVSLGQRATISYRASKSVSTSGYSYMHWNQQKPGQPPRLLIYLVSNLESGVPARFSGSGSGTDFTLNIHPVEEEDAATYYCQHIRELTRSEGGPSWKGGGGSGGGGSGGGGSEVKLEESGGDLVKPGGSLKLSCAASGFTFSGYGMSWVRQTPDKRLEWVATISSGGSYTYYPDSVKGRFTISRDNAKNTLYLQMSSLKSEDTAMYYCARHEGGYYGSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6333 - protein, 1102 aa, Artificial Sequence
  Synthetic Polypeptide encoding a CAR with optional accessory module(s)
MALPVTALLLPLALLLHAARPDDIQMTQSPSSLSASVGDRVTITCRASQGISNYLAWYQQKTGKVPKFLIYEASTLQSGVPSRFSGGGSGTDFTLTISSLQPEDVATYYCQNYNSAPFTFGPGTKVDIKGGGGSGGGGSGGGGSQVQLVESGGGVVQPGRSLRLSCAASGFAFSRYGMHWVRQAPGKGLEWVAVIWYDGSNKYYADSVKGRFTISRDNSKNTQYLQMNSLRAEDTAVYYCARGGDFLYYYYYGMDVWGQGTTVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6334 - protein, 1093 aa, Artificial Sequence
  Synthetic Polypeptide encoding a CAR with optional accessory module(s)
MALPVTALLLPLALLLHAARPDIQMTQSPSSLSTSVGDRVTLTCKASQDVGTAVDWYQQKPGPSPKLLIYWASTRHTGIPSRFSGSGSGTDFTLTISSLQPEDFADYYCQQYNSYPLTFGPGTKVDIKGGGGSGGGGSGGGGSEVQLVQSGPEVKKPGATVKISCKTSGYTFTEYTIHWVKQAPGKGLEWIGNINPNNGGTTYNQKFEDKATLTVDKSTDTAYMELSSLRSEDTAVYYCAAGWNFDYWGQGTLLTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6335 - protein, 1094 aa, Artificial Sequence
  Synthetic Polypeptide encoding a CAR with optional accessory module(s)
MALPVTALLLPLALLLHAARPDIQMTQSPSSLSASVGDRVTITCKASQDIYPYLNWFQQKPGKAPKTLIYRTNRLLDGVPSRFSGSGSGTDFTFTISSLQPYYCLQYDEFPLTFGAGTKLEIKRGGGGSGGGGSGGGGSQITLKESGPTLVKPTQTLTLTCTFSGFSLSTSNMGVGWIRQPPGKALEWLAHIWWDDDKYYSPSLKSRLTITKDTSKNQVVLTMTNMDPVDTATYYCVRSNYGYAWFAYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6336 - protein, 1094 aa, Artificial Sequence
  Synthetic Polypeptide encoding a CAR with optional accessory module(s)
MALPVTALLLPLALLLHAARPDIVMTQSQKFMSTSVGDRVNVTCKASQNVGTNVVWYQQKTGQSPKALIHSASYRYSGVPDRFTGSGSGTDFTLTLSNVQSEDLAEYFCQHYNSFPYTFGGGTKLEIKRGGGGSGGGGSGGGGSQVQLQQSGAELVRPGVSVKISCKGSGYRFTDYPIHWVKQSHAKSLEWIGIISTYYGDVTNNPKFRGKATMTVDKSSTTAYMELARLTSEDSAIYYCARNDLFAYWGQGTLVTVSATRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6337 - protein, 1097 aa, Artificial Sequence
  Synthetic Polypeptide encoding a CAR with optional accessory module(s)
MALPVTALLLPLALLLHAARPDIKMTQSPSSMYASLGERVTITCKASPDINSYLSWFQQKPGKSPKTLIYRANRLVDGVPSRFSGGGSGQDYSLTINSLEYEDMGIYYCLQYDEFPYTFGGGTKLEMKGGGGSGGGGSGGGGSEVKLVESGGGLVKPGGSLKLSCAASGFTFSSYAMSWVRQIPEKRLEWVASISRGGTTYYPDSVKGRFTISRDNVRNILYLQMSSLRSEDTAMYYCGRYDYDGYYAMDYWGQGTSVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6338 - protein, 1100 aa, Artificial Sequence
  Synthetic Polypeptide encoding a CAR with optional accessory module(s)
MALPVTALLLPLALLLHAARPDDVVVTPVSCFLSCISGAEGHHLIQGQQKCQYIWLLYALEPTETRTATQTPHLSCIQPRIWGPCQVQWQWVWDRLHPQHPSCGGGGCCNLLLSAHGAYTFGGGTRLELKGGGGSGGGGSGGGGSEVKLQESGPELVKPGASVKMSCKASGYTFTSYVMHWVKQKPGQGLEWIGYINPYNDGTKYNEKFKGKATLTSDKSSSTAYMELSSLTSEDSAVYYCARWKIYYGNYEDYWGQGTPLTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6339 - protein, 1130 aa, Artificial Sequence
  Synthetic Polypeptide encoding a CAR with optional accessory module(s)
MALPVTALLLPLALLLHAARPDEFQVQLVQSGGGLVQPGGSLRLSCAASDFDFAAYEMSWVRQAPGQGLEWVAIISHDGIDKYYTDSVKGRFTISRDNSKNTLYLQMNTLRAEDTATYYCLRLGAVGQGTLVTVSSLEGGGGSGGGGSGGGGSGSGGSGSGGSGSGGSGSGGSFEQVQLVQSGGGLVQPGGSLRLSCAASDFAFDDYEMSWVRQAPGKALEWIGDINHSGTTIYNPSLKSRVTISRDNSKNTLYLQMNTLRAEDTAIYYCARPHYGDYSDAFDIWGQGTMVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6340 - protein, 1105 aa, Artificial Sequence
  Synthetic Polypeptide encoding a CAR with optional accessory module(s)
MALPVTALLLPLALLLHAARPEIVMTQSPATLSVSPGERATLSCRASQSVSSNLAWYQQKPGQAPRLLIYGASTRATGIPARFSGSGSGTDFTLTISSLQSVDSAVYYCQQYNNWPPYTFGQGTKLEIKGGGGSGGGGSGGGGSQVQLLESGGGVVQPGRSLRLSCAASGFTFSFYGMHWVRQAPGKGLEWVAAISYDGSNKYYADSVKGRFTISRDNSKNTLYLQMNSLRAEDTAVYYCAKRPNQFYCSDGRCYSIDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6341 - protein, 1101 aa, Artificial Sequence
  Synthetic Polypeptide encoding a CAR with optional accessory module(s)
MALPVTALLLPLALLLHAARPQSVLTQPPSASAGGTPGQRVTISCSGSSSNIGSNFVYWYQQLPGTAPKLLIYRNNQRPSGVPDRFSGSRSGTSASLAGLRSEDEADYYCAADSLGGHYVFGTGTKVLGGGGSGGGGSGGGGSQVQLVESGGGSVQPGRSLRLSCEASGFTFEAYAMHWVRQPPGKGLEWVSSINWNSGRIAYADSVKGRFTISRDNARNSLYLQMNSLRLEDTAFYYCAKDIRRFSTGGAEFEYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6342 - protein, 1096 aa, Artificial Sequence
  Synthetic Polypeptide encoding a CAR with optional accessory module(s)
MALPVTALLLPLALLLHAARPENVLTQSPAIMSASPGEKVTMTCSASSSVSYMHWYQQKSSTSPKLWIYDTSKLASGVPGRFSGSGSGNSYSLTISSMEAEDVATYYCFQGSGYPLTFGAGTKLELKGGGGSGGGGSGGGGSQVQLKESGPGLVAPSQSLSITCTVSGFSLSSQGVYWVRQPPGKGLEWLGAIWAGGSTNYNSALMSRLSISKDNSKSQVFLKMNSLQTDDTAMYYCARVDGYRGYNMDYWGQGTSVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6343 - protein, 1100 aa, Artificial Sequence
  Synthetic Polypeptide encoding a CAR with optional accessory module(s)
MALPVTALLLPLALLLHAARPDDIQMTQSPSSLSASVGDRVTITCRASQSISSYLNWYQQKPGKAPKLLIYDASNLETGVPSRFSGSGSGTDFTFTISSLQPEDIATYYCQQYDNLPLTFGGGTKVDIKRGGGGSGGGGSGGGGSQVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARAHNSSSWSFDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6344 - protein, 1109 aa, Artificial Sequence
  Synthetic Polypeptide encoding a CAR with optional accessory module(s)
MALPVTALLLPLALLLHAARPDDVVMTQSPLSLPVSLGDQASISCRSSQRLVHSNGNTYLHWYLQKPGQSPKLLIYRVSNRFPGVPDRFSGSGSGTDFTLKISRVEAEDLGIYFCSQSTHVPYTFGGGTKLEIKRGGGGSGGGGSGGGGSEVRLQQSGPDLIKPGASVKMSCKASGYTFTGYVMHWVKQRPGQGLEWIGFINPYNDDIQSNERFRGKATLTSDKSSTTAYMELSSLTSEDSAVYYCARGAGYNFDGAYRFFDFWGQGTTLTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6345 - protein, 1100 aa, Artificial Sequence
  Synthetic Polypeptide encoding a CAR with optional accessory module(s)
MALPVTALLLPLALLLHAARPDSYELTQPPSVSVSPGQTATISCSGDQLGGKYGHWYQKKPGQSPVLVLYQDRKRPAGIPERFSGSSSGNTITLTISGTQAVDEADYYCQAWDTNLGGVFGGGTKVTVLGQGGGGSGGGGSGGGGSQVQLVESGAEVKKPGASVKVSCKASGYTFTGYYMHWVRQAPGQGLEWMGRINPNSGGTNYAQKFQGRVTMTRDTSISTAYMELSRLRSDDTAVYYCASPRGRGSAFDIWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6346 - protein, 1103 aa, Artificial Sequence
  Synthetic Polypeptide encoding a CAR with optional accessory module(s)
MALPVTALLLPLALLLHAARPDNFMLTQPHSVSESPGKTVTISCTRSSGSIASKYVQWYQQRPGSSPTTVIYEDNQRPSGVPDRFSGSIDTSSNSASLTISGLRTEDEADYYCHSYDSNNHSVFGGGTKVTVLGQGGGGSGGGGSGGGGSEVQLVESGGGVVQPGGSLRLSCAASGFTFSSYAMSWVRQAPGKGLEWVSAISGSGGSTYYADSVKGRFSISRDNSKNTLYLQMNSLRAEDTAVYYCARTRSSGAFDIWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6347 - protein, 1098 aa, Artificial Sequence
  Synthetic Polypeptide encoding a CAR with optional accessory module(s)
MALPVTALLLPLALLLHAARPDIQMNQSPSSLSASLGDTITITCHASQNINVWLSWYQQKPGNIPKLLIYKASNLHTGVPSRFSGSGSGTGFTITISSLQPEDIATYYCQQGQSYPWTFGGGTKLEIKRGGGGSGGGGSGGGGSEVQLQQSGPELVKPGASVKISCKASGYSFTGYFMNWVKQSHGKSLEYIGRFNPYNGETLYNQKFKGKATLTVDKSSSTVHMELLSVTSEDSAVYYCGRSGNDDAMDYWGQGTSVTVSSATRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6348 - protein, 1099 aa, Artificial Sequence
  Synthetic Polypeptide encoding a CAR with optional accessory module(s)
MALPVTALLLPLALLLHAARPDDIQMTQSPSILSASVGDRVTITCRASQRFGDYLAWYQQKPGQAPKLLIYGASTLQSGVPSRFSGSGSGTEFTLTISGLQPEDFATYYCQQANSFPITFGKGTRLDIRRGGGGSGGGGSGGGGSQVQLVQSGAEVKKPGSSVKVSCKASGGTFSSYAISWVRQAPGQGLEWMGWINVGNGNAIYSQKFQGRVTITRDTSATTAYMELSSLRSEDTAVYYCARDGERAWDLDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6349 - protein, 1104 aa, Artificial Sequence
  Synthetic Polypeptide encoding a CAR with optional accessory module(s)
MALPVTALLLPLALLLHAARPDETTLTQSPGTLSLSPGERATLSCRASQSVSSSYLAWYQQKPGQAPRLLIYGASSRATGIPDRFSGSGSGTDFTLTISRLEPEDFAVYYCQQYGSSPYTFGQGTKLEIKRGGGGSGGGGSGGGGSQVQLVQSGGGVVQPGRSLRLSCAASGFTFSSYAMHWVRQAPGKGLEWVAVISYDGSNKYYADSVKGRFTISRDNSKNTLYLQMNSLRAEDTAVYYCARELRFLEWSSDAFDIWGQGTMVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6350 - protein, 1099 aa, Artificial Sequence
  Synthetic Polypeptide encoding a CAR with optional accessory module(s)
MALPVTALLLPLALLLHAARPEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKGGGGSGGGGSGGGGSQLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTMIRGVIDSWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6351 - protein, 1096 aa, Artificial Sequence
  Synthetic Polypeptide encoding a CAR with optional accessory module(s)
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSGGGGSGGGGSQVQLVQSGAEVRKPGSSVKVSCKASGGSFNNYPIFWVRQAPGQGFEWMGRIIPILGITAYAQKFQGRVTITADKSTSTAYMELNSLRSEDTAVYYCAGGDDLDAFDIWGQGTMVSVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6352 - protein, 1108 aa, Artificial Sequence
  Synthetic Polypeptide encoding a CAR with optional accessory module(s)
MALPVTALLLPLALLLHAARPDIVMTQTPLSLPVTPGEPASISCRSSRSLLDSDDGNTYLDWYLQKPGQSPQLLIYTLSYRASGVPDRFSGSGSGTDFTLKISRVEAEDVGVYYCMQRVEFPITFGQGTRLEIKRGGGGSGGGGSGGGGSQVQLVESGGGVVQPGRSLRLSCAASGFIFSRYGMHWVRQAPGKGLKWVAVIWYDGSNKLYADSVKGRFTISRDNSKNTLYLQMNSLRAEDTAVYYCARDYYDNSRHHWGFDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6353 - protein, 1098 aa, Artificial Sequence
  Synthetic Polypeptide encoding a CAR with optional accessory module(s)
MALPVTALLLPLALLLHAARPEIQMTQSPSSMSASLGDTITITCQATQDIFKNLNWYQQKPGKPPSLLIYYATELAEGVPSRFSGSGSGSDYSLTISNLESEDFAAYYCLQFFEFPFTFGSGTKLEMKGGGGSGGGGSGGGGSQVQLQQSGAELVRPGTSVKVSCKASGYVFTNYWIEWIKQRPGQGLEWIGVMNPGSGETTYNEKFKGKATLTADKSSSTAYMQLSSLTSVDSAVYFCARDHDRDYYAMDYWGQGTSVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6354 - protein, 1095 aa, Artificial Sequence
  Synthetic Polypeptide encoding a CAR with optional accessory module(s)
MALPVTALLLPLALLLHAARPDILLTQSPAILSVSPGERVSFSCRASQNIGTSIHWYQQRTNGSPRLLIKYASESVSGIPSRFSGSGSGTDFTLSINSVESEDIADYYCQHTNSWPTTFGGGTKLEIKRGGGGSGGGGSGGGGSQVQLQQSDAELVKPGASVKISCKASGYTFTDHAIHWVKQKPEQGLEWIGYFSPGNGDIKYNEKFKGKATLTADKSSSTAYMQLNSLTSEDSAVYFCKRSYGNYDYWGQGTTLTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6355 - protein, 1100 aa, Artificial Sequence
  Synthetic Polypeptide encoding a CAR with optional accessory module(s)
MALPVTALLLPLALLLHAARPDIVMTQSPDSLAVSLGERATINCKSSQSLLNSGDQKNYLTWYQQKPGQPPKLLIYWASTRESGVPDRFSGSGSGTDFTLTISSLQAEDVAVYYCQNDYSYPLTFGQGTKVEIKGGGGSGGGGSGGGGSQVQLVQSGAEVKKTGSSVKVSCKASGYTFTDHAIHVWRQAPGQALEWMGHFSPGNTDIKYNDKFKGRVTLTVDRSMSTAYMELSSLRSEDTAMYYCKTSTFFFDYWGQGTMVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6356 - protein, 1022 aa, Artificial Sequence
  Synthetic Polypeptide encoding a CAR with optional accessory module(s)
MELTELLLVVMLLLTARLTLSSPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQLPPQGRTTAHKDPNAIFLSFQHLLRGKVRFLMLVGGSTLCVRRAPPTTAVPSRTSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6357 - protein, 1099 aa, Artificial Sequence
  Synthetic Polypeptide encoding a CAR with optional accessory module(s)
MALPVTALLLPLALLLHAARPDIQMTQSPSSLSASVGDRVTITCKASQDVSIAVAWYQQKPGKAPKVLIYSASYRYTGVPDRFSGSGSGTDFTFTISSLQPEDIAVYYCQQHYITPLTFGGGTKVEIKGGGGSGGGGSGGGGSQIQLVQSGHEVKKPGASVKVSCKASGYTFTNYGMNWVRQAPGQGLEWMGWINTKTGEPTYAEEFKGRFVFSLETSASTAYLQISSLKAEDTAMYFCGRGGYGSSYWYFDVWGQGTTVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6358 - protein, 1101 aa, Artificial Sequence
  Synthetic Polypeptide encoding a CAR with optional accessory module(s)
MALPVTALLLPLALLLHAARPDIVMTQSPDSLAVSLGERATINCRASKSVSTSGYSYMHWYQQKPGQPPKLLIYLASNLESGVPDRFSGSGSGTDFTLTISSLQAEDVAVYYCQHSRELPYTFGQGTKLEIKGGGGSGGGGSGGGGSQVQLQESGPGLVKPSETLSLTCTVSGGSISSYGVHWIRQPPGKGLEWIGVIWTSGVTDYNSALMGRVTISVDTSKNQFSLKLSSVTAADTAVYYCARDGDYDRYTMDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6359 - protein, 1080 aa, Artificial Sequence
  Synthetic Polypeptide encoding a CAR with optional accessory module(s)
MTALFLMSMLFGLACGQAMSFCIPTEYTMHIERRECAYCLTINTTICAGYCMTRDINGKLFLPKYALSQDVCTYRDFIYRTVEIPGCPLHVAPYFSYPVALSCKCGKCNTDYSDCIHEAIKTNYCTKPQKSYLVGFSVGGGGSGGGGSGGGGSAPDVQDCPECTLQENPFFSQPGAPILQCMGCCFSRAYPTPLRSKKTMLVQKNVTSESTCCVAKSYNRVTVMGGFKVENHTACHCSTCYYHKSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6360 - protein, 1097 aa, Artificial Sequence
  Synthetic Polypeptide encoding a CAR with optional accessory module(s)
MALPVTALLLPLALLLHAARPQSVLTQPPSVSVSPGQTASITCSGDKLGDKYACWYQQKPGQSPVLVIYQDSKRPSGIPERFSGSNSGNTATLTISGTQAMDEADYYCQAWDSSTAVVFGGGTKLTVLGGGGSGGGGSGGGGSQVQLVQSGAEVKKPGQSLKISCKASGYSLTDNWIGWVRQKPGKGLEWMGIIYPGDSDTRYSPSFQGQVTISADKSINTAYLQWSSLKASDTAIYYCVGLDWNYNPLRYWGPGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6361 - protein, 1095 aa, Artificial Sequence
  Synthetic Polypeptide encoding a CAR with optional accessory module(s)
MALPVTALLLPLALLLHAARPDIVMTQSQKFMSTSVGDRVSIICKASQNVGTFVAWYQQKPGQSPKLLVYSASNRYTGVPDRFTGSGSGTDFTLTINNMQSEDLADYFCRQYSSYPYTFGGGTKLEIKGGGGSGGGGSGGGGSEVQLQQSGPELVKPGASMKISCKASGYSFSAYTMNWVKQSHGKNLEWIGLINPYNGGTNYNQEFEGKATLTVNKSSNTAFMELLSLTSDDSAVYYCARRDWDYFDYWGQGTTLTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6362 - protein, 1106 aa, Artificial Sequence
  Synthetic Polypeptide encoding a CAR with optional accessory module(s)
MALPVTALLLPLALLLHAARPAIQMTQSPSSLSASVGDRVTITCRASQSISNYLNWYQQKPGKAPKLLIYAASSLQSGVPSRFSGSGSGTDFTLTISSLQPEDFATYYCQQSYSSPSTTFGQGTKLEIKRGGGGSGGGGSGGGGSEVQLVESGGGLIQPGGSLRLSCAASGFTVSSNYMSWVRQAPGKGLEWVSVTYSGGSTSYADSVKGRFTISRDNSKNTLYLQMNSLRAEDTAVYYCARGGRYCSSISCYARSGCDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6363 - protein, 1101 aa, Artificial Sequence
  Synthetic Polypeptide encoding a CAR with optional accessory module(s)
MALPVTALLLPLALLLHAARPDIQMTQSPSSLSASVGDRVTITCRASQSIGTSLHWYQQKPGKAPKLLIKFASRLQSGVPSRFSGSGSGTDFTLTISSLQPEDFATYYCQQSPGFPPTFGQGTKLEIKRGGGGSGGGGSGGGGSQVQLVESGGGLVKPGGSLRLSCAASGFSITTSGYYWTWIRQFPGKGLEWMGYIGYNSKTYYNPALKSRITISRDNAKNSLYLQMNSLRAEDTAVYYCARSLYGGYKDAFDSWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6364 - protein, 1106 aa, Artificial Sequence
  Synthetic Polypeptide encoding a CAR with optional accessory module(s)
MALPVTALLLPLALLLHAARPDEIVLTQSPLSLPVTPGEPASISCRSSQSLLHSIGYNYLDWYLQKPGQSPQLLIYLGSNRASGVPDRFSGSGSGTDFTLKISRVEAEDVGVYYCMQALQTPLTFGGGTKVEIKRGGGGSGGGGSGGGGSEVQLVESGGGVVQPGRSLRLSCAASGFTFRSYGMHWVRQAPGKGLEWVAVISYDGSNKYYTDSVNGRFTISRDNSKNTLYLQMNSLRAEDTAVYYCARGGGYYETSGPDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6365 - protein, 1104 aa, Artificial Sequence
  Synthetic Polypeptide encoding a CAR with optional accessory module(s)
MALPVTALLLPLALLLHAARPDDVVMTQSPLSLPVTPGEPASISCRSSQSLLHSIGYNYLHWFLQKPGQSPQLLIYLGSNRASGVPDRFSGSGSGTDFTLKISRVEAEDVGVYYCMQALQTPPTFGQGTRLEIKRGGGGSGGGGSGGGGSQLQLQESGPGLVKPSGTLSLTCAVSGGSISSSNWWSWVRQPPGKGLEWIGEIYHSGSTNYNPSLKSRVTISVDKSKNQFSLKLSSVTAADTAVYYCVGSPYGDYVLDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6366 - protein, 1107 aa, Artificial Sequence
  Synthetic Polypeptide encoding a CAR with optional accessory module(s)
MALPVTALLLPLALLLHAARPDVVMTQSPLSLPVTPGEPASISCRSSQSLLHSNGHNYLDWYLQKPGQSPQLLIYLGSNRASGVPDRFSGSGSGTDFTLKISRVEAEDVGVYYCMQTLQTPLTFGPGTKVDIKRGGGGSGGGGSGGGGSEVQLVETGGGVVQPGRSLRLSCAASGFTFSSYGMHWVRQAPGKGLEWVAVISYDGSNKYYADSVKGRFTISRDNSKNTLYLQMNSLRAEDTAVYYCAKDRYGWGSSFGHFDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6367 - protein, 1102 aa, Artificial Sequence
  Synthetic Polypeptide encoding a CAR with optional accessory module(s)
MALPVTALLLPLALLLHAARPDEIVLTQSPGTLSLSLGERATLSCRASQSISSSFLAWYQQKPGQAPKLLIYAASTRATGIPDRFSGSGSGTDFTLTISRLEPEDFAVYYCQQYGRSLSFGGGTKVEVKGGGGSGGGGSGGGGSQVQLQQSGPGLVKPSQTLSLTCAISGDSVSGNSATWNWIRQSPSRGLEWLGRTYYRSKWNHDYAESVKSRITINPDTSKNQFSLQLNSVTPEDTAVYYCARGDSSSWYAFDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6368 - protein, 1102 aa, Artificial Sequence
  Synthetic Polypeptide encoding a CAR with optional accessory module(s)
MALPVTALLLPLALLLHAARPDQTVVTQPPSASGTPGQRVTISCSGSSSNIGSNYVYWYQQLPGTAPKLLIYRSNQRPSGVPDRFSGSKSGTSASLAISGPRSVDEADYYCAAWDDSLNGVVFGGGTKLTVLGGGGGSGGGGSGGGGSQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARRIPPYYGMDVWGQGTTVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6369 - protein, 1102 aa, Artificial Sequence
  Synthetic Polypeptide encoding a CAR with optional accessory module(s)
MALPVTALLLPLALLLHAARPDQSVVTQPPSVSVAPGKTARITCGRNNIGSKSVHWYQQKPGQAPVLVVYDDSDRPSGIPERFSGSNSGNTATLTISRVEAGDEADYYCQVWDSSSDHVVFGGGTKLTVLGGGGGSGGGGSGGGGSEVQLVQSGGGVVRPGGSLRLSCAASGFTFDDYGMSWVRQAPGKGLEWVSGINWNGGSTGYADSVRGRFTISRDNAKNSLYLQMNSLRAEDTALYYCARERGYGYHDPHDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6370 - protein, 1114 aa, Artificial Sequence
  Synthetic Polypeptide encoding a CAR with optional accessory module(s)
MALPVTALLLPLALLLHAARPEQKLISEEDLEFQAVVTQPPSASGTPGQRVTISCSGSSSNIGSNTVNWYQQVPGTAPKLLIYSNNQRPSGVPDRFSGSKSGTSASLAISGLQSEDEADYYCAAWDDSLNGWVFGGGTKLTVLGGGGSGGGGSGGGGSQMQLVQSGAEVKEPGESLRISCKGSGYSFTNFWISWVRQMPGKGLEWMGRVDPGYSYSTYSPSFQGHVTISADKSTSTAYLQWNSLKASDTAMYYCARVQYSGYYDWFDPWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6371 - protein, 1108 aa, Artificial Sequence
  Synthetic Polypeptide encoding a CAR with optional accessory module(s)
MALPVTALLLPLALLLHAARPEQKLISEEDLEFDIQMTQSPSTLSASVGDRVTITCRASQNINKWLAWYQQRPGKAPQLLIYKASSLESGVPSRFSGSGSGTEYTLTISSLQPDDFATYYCQQYNSYATFGQGTKVEIKRGGGGSGGGGSGGGGSQVQLVQSGAEVKKPGESLKISCKGSGYNFSNKWIGWVRQLPGRGLEWIAIIYPGYSDITYSPSFQGRVTISADTSINTAYLHWHSLKASDTAMYYCVRHTALAGFDYWGLGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6372 - protein, 1098 aa, Artificial Sequence
  Synthetic Polypeptide encoding a CAR with optional accessory module(s)
MALPVTALLLPLALLLHAARPEIVLTQSPGTLSLSPGERATLSCRASQSVSNTYLAWYHQRPGQAPRLLIYGASSRATGIPDRFSGSGSGTDFALTISSLEPEDFAVYYCQQYSNSWTFGQGTKVEIKRGGGGSGGGGSGGGGSQVQLVESGGGVVQPGRSLRLSCAASGFTFSSYDMHWVRQAPGKGLEWVAVISYDGTNEYYADSVKGRFTISRDTSKNTLYLQMNSLRAEDTAVYYCARERYFDWSFDYWGQGTLVSVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6373 - protein, 1097 aa, Artificial Sequence
  Synthetic Polypeptide encoding a CAR with optional accessory module(s)
MALPVTALLLPLALLLHAARPELTQDPAVSVALGQTVRITCQGDSLRSNYANWYQQKPGQAPVLVIYGQNNRPSGIPDRFSGSSSGNTASLTITGAQAADEADYYCDSRVSTGNHVVFGGGTKLTVLGQGGGGSGGGGSGGGGSEVQLVQSGAEVKKPGASVKVSCKASGYTFTSYAMHWVRQAPGQRLEWMGWINAGNGNTKYSQKFQGRVTITRDTSASTAYMELSSLRSEDTAVYYCARDISYGSFDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6374 - protein, 1099 aa, Artificial Sequence
  Synthetic Polypeptide encoding a CAR with optional accessory module(s)
MALPVTALLLPLALLLHAARPDIVLTQTPATLSVTPGDSVSLSCRASQSISNNLHWYQQKSHESPRLLIKNASQSISGIPSKFSGSGSGTDFTLRINSVETEDFGMYFCQQSNSWPYTFGSGTKLEIKGGGGSGGGGSGGGGSQVKLQQSGPELVKPGASVKISCKASGYSFTGYYMHWVKQSHGNILDWIGYIYPYNGVSSYNQKFKGKATLTVDKSSSTAYMELRSLTSEDSAVYYCARERGLYQLRAMDYWGQGTSVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6375 - protein, 1090 aa, Artificial Sequence
  Synthetic Polypeptide encoding a CAR with optional accessory module(s)
MALPVTALLLPLALLLHAARPDIVMTQTPAIMSASPGQKVTITCSASSSVNYMHWYQQKLGSSPKLWIYDTSKLAPGVPARFSGSGSGTSYSLTISSMEAEDAASYFCHQWSSYPYTFGSGTKLEIKGGGGSGGGGSGGGGSEVQLQESGPDLVKPSQSLSLTCTVTGYSITSGYGWHWIRQFPGNKLEWMGYIHYSGSTTYNPSLKSRISISRDTSKNQFFLQLNSVTTEDTATYYCARSLRYWGQGTTLTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6376 - protein, 1093 aa, Artificial Sequence
  Synthetic Polypeptide encoding a CAR with optional accessory module(s)
MALPVTALLLPLALLLHAARPDIQMTQSPSSLSASVGDRVTITCSATSSISYMHWYQQKPGKAPKGWIYDTSKLAHGVPSRFSGSGSGTDFTLTISSLQPEDFATYYCHQRRSYPFTFGQGTKVEIKGGGGSGGGGSGGGGSEVQLVQSGAEVKKPGASVKVSCKASGYTFTNFWIHWVRQAPGQGLEWIGEIDPSDSYTNYNQKFKGRVTITRDTSTSTAYLELSSLRSEDTAVYYCAREITTVDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6377 - protein, 1100 aa, Artificial Sequence
  Synthetic Polypeptide encoding a CAR with optional accessory module(s)
MALPVTALLLPLALLLHAARPDIQMTQSPSSLSASVGDRVTITCKASQGFNKYVAWYQQKPGKAPKLLIYYTSTLQPGVPSRFSGSGSGRDYTLTISSLQPEDFATYYCLQYGNLLYAFGQGTKVEIKRGGGGSGGGGSGGGGSEVQLVQSGAEVKKPGASVKVSCKASGYTFTSYWIGWVRQAPGQGLEWIGDIYPGGGYTNYNEKFKGRVTITRDTSTSTAYLELSSLRSEDTAVYYCARLDGSSYRGAMDSWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6378 - protein, 1104 aa, Artificial Sequence
  Synthetic Polypeptide encoding a CAR with optional accessory module(s)
MALPVTALLLPLALLLHAARPDIQLTQSPSSLSASVGDRVTITCRASQSVDYDGDSYMNWYQQKPGKAPKLLIYAASYLESGVPSRFSGSGSGTDFTLTISSLQPEDFATYYCQQSHEDPYTFGQGTKVEIKRGGGGSGGGGSGGGGSEVQLVESGGGLVQPGGSLRLSCAVSGYSITSGYSWNWIRQAPGKGLEWVASITYDGSTNYNPSVKGRITISRDDSKNTFYLQMNSLRAEDTAVYYCARGSHYFGHWHFAVWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6379 - protein, 1096 aa, Artificial Sequence
  Synthetic Polypeptide encoding a CAR with optional accessory module(s)
MALPVTALLLPLALLLHAARPDIQMTQSPSSLSASVGDRVTITCRASQDIRYYLNWYQQKPGKAPKLLIYVASSLQSGVPSRFSGSGSGTEFTLTVSSLQPEDFATYYCLQVYSTPRTFGQGTKVEIKGGGGSGGGGSGGGGSEVQLVESGGGLAKPGGSLRLSCAASGFRFTFNNYYMDWVRQAPGQGLEWVSRISSSGDPTWYADSVKGRFTISRENAKNTLFLQMNSLRAEDTAVYYCASLTTGSDSWGQGVLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6380 - protein, 1097 aa, Artificial Sequence
  Synthetic Polypeptide encoding a CAR with optional accessory module(s)
MALPVTALLLPLALLLHAARPEIVMTQSPATLSVSPGERATLSCRASQSVSRNLAWYQQKPGQAPRLLIYGASTRATGIPARFSGSGSGTEFTLTIGSLQSEDFAVYYCQQYKTWPRTFGQGTNVEIKGGGGSGGGGSGGGGSQVQLQQWGAGLLKPSETLSLTCAVFGGSFSGYYWSWIRQPPGKGLEWIGEINHRGNTNDNPSLKSRVTISVDTSKNQFALKLSSVTAADTAVYYCARERGYTYGNFDHWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6381 - protein, 1098 aa, Artificial Sequence
  Synthetic Polypeptide encoding a CAR with optional accessory module(s)
MALPVTALLLPLALLLHAARPEIVMTPSSATLSVSPGERATLSCRASQSVSRNLAWYQQKPGQAPRLLIYGASTRATGIPARFSGSGSGTEFTLTISSLQSEDFAVYYCHQYSNWMCSFGQGTKLEIKGGGGSGGGGSGGGGSEVQLLESGGGLVQPGGSLRLSCAASGFTFSRYAMNWVRQAPGKGLEWVSGISGSGGRTYYADSVKGRFTISRDNSKNTLYLQMNSLRAEDTAVYYCAKDRDFWSGPFDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6382 - protein, 1098 aa, Artificial Sequence; identical to SEQ ID NO: 6381
  Synthetic Polypeptide encoding a CAR with optional accessory module(s)

SEQ ID NO: 6383 - protein, 1100 aa, Artificial Sequence
  Synthetic Polypeptide encoding a CAR with optional accessory module(s)
MALPVTALLLPLALLLHAARPQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSELVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6384 - protein, 1101 aa, Artificial Sequence
  Synthetic Polypeptide encoding a CAR with optional accessory module(s)
MALPVTALLLPLALLLHAARPEVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDKGGGYYDFWSGSDYWGQGTLVTVSSGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCNSRDSSGWVFGGGTKLTVLTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6385 - protein, 1110 aa, Artificial Sequence
  Synthetic Polypeptide encoding a CAR with optional accessory module(s)
MALPVTALLLPLALLLHAARPEVQLQQSGPGLVKPSQTLSLTCAISGDSVLSNSDTWNWIRQSPSRGLEWLGRTYHRSTWYDDYASSVRGRVSINVDTSKNQYSLQLNAVTPEDTGVYYCARDRLQDGNSWSDAFDVWGQGTMVTVSSGGGGSGGGGSGGGGSQSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLVYVFGTGTKVTVLTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6386 - protein, 1108 aa, Artificial Sequence
  Synthetic Polypeptide encoding a CAR with optional accessory module(s)
MALPVTALLLPLALLLHAARPQVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARGDSNYWSYYGMDVWGQGTLVTVSSGGGGSGGGGSGGGGSGGGGSQSVLTQPRSVSGSPGQSVTISCTGTSSDVGGYNYVSWYQQHPGEAPKLIIYDADKRPSGISNRFSSGKSGNTASLTISGLQVEDEADYYCCSYAGGSTWVFGGGTKVTVLTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6387 - protein, 1110 aa, Artificial Sequence
  Synthetic Polypeptide encoding a CAR with optional accessory module(s)
MALPVTALLLPLALLLHAARPEVQLQQSGPGLVKPSQTLSLTCAISGDSVSSNSAAWNWIRQSPSRGLEWLGRTYYRSKWYSDYAVSVKSRITINPDTSKNQFSLQLNSVTPEDTAVYYCARDPYDFWSGYPDAFDIWGQGTMVTVSSGGGGSGGGGSGGGGSQSALTQPASVSGSPGQSITISCTGTSSDVGGYNYVSWYQQHPGKAPKVIISEVNNRPSGVSHRFSGSKSGNTASLTISGLQAEDEADYFCSSYTSGRTLYVFGTGSKVTVLGTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6388 - protein, 1109 aa, Artificial Sequence
  Synthetic Polypeptide encoding a CAR with optional accessory module(s)
MALPVTALLLPLALLLHAARPEVQLQQSGPGLVKPSQTLSLTCAISGDSMLSNSDTWNWIRQSPSRGLEWLGRTYHRSTWYDDYASSVRGRVSINVDTSKNQYSLQLNAVTPEDTGVYYCARVRLQDGNSWSDAFDVWGQGTMVTVSSGGGGSGGGGSGGGGSQSALTQPASASGSPGQSVTISCTGTSSDVGGYNYVSWYQQHPGKAPKLMIYDVSNRPSGVSNRFSGSKSGNTASLTISGLQAEDEADYYCSSYTSSSTLYVFGTGTQLTVLTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6389 - protein, 1100 aa, Artificial Sequence; identical to SEQ ID NO: 6383
  Synthetic Polypeptide encoding a CAR with optional accessory module(s)

SEQ ID NO: 6390 - protein, 1109 aa, Artificial Sequence
  Synthetic Polypeptide encoding a CAR with optional accessory module(s)
MALPVTALLLPLALLLHAARPDVMLTQTPLSLPVSLGDQASISCRSSQSILHSTGDTYLEWYLQKPGQSPKLLINKVSNRLSGVPDRFSGSGSGTDFTLKISRVEAEDLGVYYCFQGSHVPWTFGGGTKLEIKRADAAPTVSIFPGGGGSGGGGSGGGGSQVKLQQSGPSLVKPGASVKMSCKASGYTFTDFYMKWVKQSHGKSLEWIGDINPNIGDTFYNQKFKGKATLTVDKSSSTAYMQLNSLTSEDSAVYFCSVGYFDVWGAGTTVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6391 - protein, 1105 aa, Artificial Sequence
  Synthetic Polypeptide encoding a CAR with optional accessory module(s)
MALPVTALLLPLALLLHAARPEIVLTQSPATLSLSPGERATLSCRASQSVSIYLAWYQQKPGQAPRLLIYDASNRATGIPARFSGSGSGTDFTLTISSLEPEDFAVYYCQQRSNWPPFTFGPGTKVDIKGGGGSGGGGSGGGGSQVQLVESGGGVVQPGRSLRLSCAASGFTFSSYGMHWVRQAPGKGLEWVAVIWDDGSNKYYVDSVKGRFTISRDNSKNTLYLQMNSLRAEDTAVYYCARDDYYGSGSFNSYYGTDVWGQGTTVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6392 - protein, 1090 aa, Artificial Sequence
  Synthetic Polypeptide encoding a CAR with optional accessory module(s)
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSGGGGSGGGGSEVQLVQSGGGLVHPGGSLRLSCAGSGFTFSTYLMYWVRQAPGKTLEWVSAIGSGGDTYYADSVKGRFTISRDNAKNSLYLQMNSLRAEDMAVYYCARGLGYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6393 - protein, 1109 aa, Artificial Sequence
  Synthetic Polypeptide encoding a CAR with optional accessory module(s)
MALPVTALLLPLALLLHAARPLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGGGGSGGGGSGGGGSEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6394 - protein, 1099 aa, Artificial Sequence
  Synthetic Polypeptide encoding a CAR with optional accessory module(s)
MALPVTALLLPLALLLHAARPQSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSVFGTGTKVLVLGGGGSGGGGSGGGGSQVQLVQSGAEVKKPGSSVKVSCKASGGTFSSYTINVWRQAPGQGLEWMGGFIPISGTVNYAQKFQGRVTITADESTSTAYMELSSLRSEDTAVYYCARPLDWTEDIWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6395 - protein, 1102 aa, Artificial Sequence
  Synthetic Polypeptide encoding a CAR with optional accessory module(s)
MALPVTALLLPLALLLHAARPNFMLTQPHSVSESPGKTVTISCTGSSGSIASNYVQWYQQRPGSAPTILIYEDNKRPSGVPDRFSGSIDSSSNSASLTISGLKTGDEADYYCQSYDDINHWVFGGGTKLTVLGGGGGSGGGGSGGGGSEVQLVQSGAEVKKPGASVKVSCKASGYTFTAYYLHWLRQAPGQGLEWMGWMNTNNGATRYAQKFQDRVTMTRDTSINTAYMEMSGLSSDDTAMYYCARGDISQDFADVWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6396 - protein, 1094 aa, Artificial Sequence
  Synthetic Polypeptide encoding a CAR with optional accessory module(s)
MALPVTALLLPLALLLHAARPQIVLTQSPAIMSASPGEKVTITCSASSSVSYMHWFQQKPGTSPKLWIYSTSNLASGVPARFSGSGSGTSYSLTISRMEAEDAATYYCQQRSSYPPTFGGGTKLEIKGGGGSGGGGSGGGGSQVQLQQSGAELMKPGASVKISCKATGYTFSSYWIEWVKQRPGHGLEWIGEILPGSGSTNYNEKFKGKATFTADTSSNTAYMQLSSLTSEDSAVYYCARYDYPWFAYWGQGTLVTVSATRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6397 - protein, 1102 aa, Artificial Sequence
  Synthetic Polypeptide encoding a CAR with optional accessory module(s)
MALPVTALLLPLALLLHAARPDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPFTFGSGTKLEIKGGGGSGGGGSGGGGSQVQLQQPGAELVRPGASVKLSCKASGYTFTSYWINWVKQRPGQGLEWIGNIYPSDSYTNYNQKFKDKATLTVDKSSSTAYMQLSSPTSEDSAVYYCTRSWRGNSFDYWGQGTTLTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6398 - protein, 1100 aa, Artificial Sequence
  Synthetic Polypeptide encoding a CAR with optional accessory module(s)
MALPVTALLLPLALLLHAARPDTQMTQSPSSVSASVGDRVTITCRTSQDISNYLNWYQQKPGKAPKLLIYNTSRLHSGVPSRFSGSGSGTDFTLTISSLQPEDFATYYCQQSNMFPYTFGQGTKLEIKGGGGSGGGGSGGGGSQVQLVQSGAEVKKPGASVKVSCKASGYTFNGYFMNWVRQAPGQGLERMGRINPNNGDSFYNQKFQGRVTMTRDTSTSTVYMELPSLRSEDTAVYYCAREGYYGGRGYALDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6399 - protein, 1105 aa, Artificial Sequence
  Synthetic Polypeptide encoding a CAR with optional accessory module(s)
MALPVTALLLPLALLLHAARPDIVMTQSPSSLAMSVGQKVTMTCKSSQSLLNSSNQKNYLAWYQQKPGQSPKLLVYFASTRESGVPDRFIGSGSGTDFTLTISSVQAEDLADYFCHQHYSTPLTFGAGTKLELKGGGGSGGGGSGGGGSEVQLQQSGPDLVKPGASVKMSCKASGYTFTSYVMHWVKQKPGQGLEWIGYIYPYNDGTKYNEKFKGKATLTSDKSSSTAYMELSSLTSEDSAVYYCAREEYGNYVRYFDVWGAGTTVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6400 - protein, 1099 aa, Artificial Sequence
  Synthetic Polypeptide encoding a CAR with optional accessory module(s)
MALPVTALLLPLALLLHAARPQSVVTQPPSVSAAPGQKVTISCSGSSSNIGNNYVSWYQQLPGTAPKLLIYDNNKRPSGIPDRFSASKSGTSATLGITGLQTRDEADYYCGTWDSSLSAWVFGGGTKLTVLGGGGGSGGGGSGGGGSQVQLVQSGAEVKKPGSSVKVSCKASGDTFSSYYISWVRQAPGQGLEWMGRIIPILGIANYAQKYQGRVTLSADKSTSTSYMELNSLSSEDTAVYYCALDWSYSIDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6401 - protein, 1105 aa, Artificial Sequence
  Synthetic Polypeptide encoding a CAR with optional accessory module(s)
MALPVTALLLPLALLLHAARPEFEVKLVESGGGLVKFGGSLKLSCAASGFTLSSYYMSWVRQSPEKRLELVAVINSNGGSTYYPDTVKGRFTISRDNAKNTLYLQMSSLKSEDTALYYCARPFYYSNSPFAYWGQGTLVTVSAGGGGSGGGGSGGGGSDVLMTQTPLSLPVSLGDQASISCRSSQSIVHRTGNTYLEWYLQKPGQSPKLLIYKVSNRFSGVPDRFSGSGSGTDFTLKISRVGAEDLGVYYCFQGSHVPYTFGGGTKLEIKTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6402 - protein, 1102 aa, Artificial Sequence
  Synthetic Polypeptide encoding a CAR with optional accessory module(s)
MALPVTALLLPLALLLHAARPELVMTQSPASLAVSLGQRATISCRASESVDSYGKSFMHWYQLKPGQPPKLLIYRASNLESGVPARFSGSGSRTDFTLTIDPVEADDAATYYCQQNNEDPWTFGGGTKLEIKGGGGSGGGGSGGGGSEVQLEQSGPELVKPGASVKMSCKASGYTFTNYYMKWVKQSHGKSLEWIGDLNPNNGDTFYNQKFKGKATLTVDKSSNTAYMQLNSLTSEDSAVYYCARTGRYEENAMDYWGQGTSVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6403 - protein, 1096 aa, Artificial Sequence
  Synthetic Polypeptide encoding a CAR with optional accessory module(s)
MALPVTALLLPLALLLHAARPDVVMTQSPSSLSASVGDRVTITCMASEDIYIRLAWYQQKPGNAPKLLIYAATSLETGVPSRFSGSGSGTDFTLTISSLQPEDFATYYCQQYWSSPWTFGGGTKVEIKGGGGSGGGGSGGGGSQVQLQESGPGLVKPSQTLSLTCTVSGYSITSDYTWNWIRQPPGNGLEWIGYITYSGSTSYNPSLKSRVLISVDTSKNQVSLKLSSVTAADTAVYYCARLGRRYTMDYWGQGTTVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6404 - protein, 1103 aa, Artificial Sequence
  Synthetic Polypeptide encoding a CAR with optional accessory module(s)
MALPVTALLLPLALLLHAARPDVLMTQTPVSLSVSLGDQASISCRSSQSIVHSTGNTYLEWYLQKPGQSPKLLIYKISNRFSGVPDRFSGSGSGTDFTLKISRVEAEDLGVYYCFQASHAPRTFGGGTKLEIKRGGGGSGGGGSGGGGSEVILVESGGGLVKPGGSLKLSCAASGFTFSSYTMSWVRQTPEKRLEWVATISSGGGNTYYPDSVKGRFTISRDNAKNNLYLQMSSLRSEDTALYYCARYYRYEAWFASWGQGTLVTVSATRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6405 - protein, 973 aa, Artificial Sequence
  Synthetic Polypeptide encoding a CAR with optional accessory module(s)
MALPVTALLLPLALLLHAARPQVKLEESGGGLVQAGRSLRLSCAASEHTFSSHVMGWFRQAPGKERESVAVIGWRDISTSYADSVKGRFTISRDNAKKTLYLQMNSLKPEDTAVYYCAARRIDAADFDSWGQGTQVTVSSFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6406 - protein, 972 aa, Artificial Sequence
  Synthetic Polypeptide encoding a CAR with optional accessory module(s)
MALPVTALLLPLALLLHAARPEVQLVESGGGLVQAGGSLRLSCAASGRTFTMGWFRQAPGKEREFVAAISLSPTLAYYAESVKGRFTISRDNAKNTVVLQMNSLKPEDTALYYCAADRKSVMSIRPDYWGQGTQVTVSSFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6407 - protein, 1106 aa, Artificial Sequence
  Synthetic Polypeptide encoding a CAR with optional accessory module(s)
MALPVTALLLPLALLLHAARPQVKLEESGGGLVQAGRSLRLSCAASEHTFSSHVMGWFRQAPGKERESVAVIGWRDISTSYADSVKGRFTISRDNAKKTLYLQMNSLKPEDTAVYYCAARRIDAADFDSWGQGTQVTVSSGGGGSGGGGSGGGGSEVQLVESGGGLVQAGGSLRLSCAASGRTFTMGWFRQAPGKEREFVAAISLSPTLAYYAESVKGRFTISRDNAKNTVVLQMNSLKPEDTALYYCAADRKSVMSIRPDYWGQGTQVTVSSFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6408 - protein, 970 aa, Artificial Sequence
  Synthetic Polypeptide encoding a CAR with optional accessory module(s)
MALPVTALLLPLALLLHAARPEVQLVESGGGLVQAGGSLRLSCIATGKVFSIYDMGWYRQAPGKQRELVAEITSSGTTHYDDFVSGRFTISRDNAKNTVYLQMNTLKAEDTAVYYCRANHVFGGSYWGQGTQVTVSSFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6409 - protein, 976 aa, Artificial Sequence
  Synthetic Polypeptide encoding a CAR with optional accessory module(s)
MALPVTALLLPLALLLHAARPQVQLVESGGGLVQPGGSLRLSCEASGFTLDYYAIGWFRQAPGKEREGVICISRSDGSTYYADSVKGRFTISRDNAKKTVYLQMISLKPEDTAAYYCAAGADCSGYLRDYEFRGQGTQVTVSSFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6410 - protein, 1099 aa, Artificial Sequence
  Synthetic Polypeptide encoding a CAR with optional accessory module(s)
MALPVTALLLPLALLLHAARPEVQLVESGGGLVQAGGSLRLSCIATGKVFSIYDMGWYRQAPGKQRELVAEITSSGTTHYDDFVSGRFTISRDNAKNTVYLQMNTLKAEDTAVYYCRANHVFGGSYWGQGTQVTVSSEVAALEKQVQLVESGGGLVQPGGSLRLSCEASGFTLDYYAIGWFRQAPGKEREGVICISRSDGSTYYADSVKGRFTISRDNAKKTVYLQMISLKPEDTAAYYCAAGADCSGYLRDYEFRGQGTQVTVSSFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6411 - protein, 982 aa, Artificial Sequence
  Synthetic Polypeptide encoding a CAR with optional accessory module(s)
MALPVTALLLPLALLLHAARPQVKLEESGGRLVQPRGSLRLSCAGSGRTFSTYGMAWFRQAPGKEREFVASKASMNYSGRTYYADSVKGRFTIARDNAKNMVFLQMNNLKPEDTAVYYCAAGTGCSTYGCFDAQIIDYWGKGTLVTVSSFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6412 - protein, 973 aa, Artificial Sequence
  Synthetic Polypeptide encoding a CAR with optional accessory module(s)
MALPVTALLLPLALLLHAARPQVKLEESGGGLVQPGESLRLSCSASGSIFKVFRVFAMSWYRQGPGKQRELVASISSGETTTYADSVKGRFTISRDNAKNTAYLQMDSLKPEDTAVYYCNADHTFTGDFWGQGTQVTVSSFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6413 - protein, 1108 aa, Artificial Sequence
  Synthetic Polypeptide encoding a CAR with optional accessory module(s)
MALPVTALLLPLALLLHAARPQVKLEESGGRLVQPRGSLRLSCAGSGRTFSTYGMAWFRQAPGKEREFVASKASMNYSGRTYYADSVKGRFTIARDNAKNMVFLQMNNLKPEDTAVYYCAAGTGCSTYGCFDAQIIDYWGKGTLVTVSSEVAALEKQVKLEESGGGLVQPGESLRLSCSASGSIFKVFRVFAMSWYRQGPGKQRELVASISSGETTTYADSVKGRFTISRDNAKNTAYLQMDSLKPEDTAVYYCNADHTFTGDFWGQGTQVTVSSFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6414 - protein, 971 aa, Artificial Sequence
  Synthetic Polypeptide encoding a CAR with optional accessory module(s)
MALPVTALLLPLALLLHAARPQVKLEESGGELVQPGGPLRLSCAASGNIFSINRMGWYRQAPGKQRAFVASITVRGITNYADSVKGRFTISVDKSKNTIYLQMNALKPEDTAVYYCNAVSSNRDPDYWGQGTQVTVSSFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6415 - protein, 983 aa, Artificial Sequence
  Synthetic Polypeptide encoding a CAR with optional accessory module(s)
MALPVTALLLPLALLLHAARPPVQLVESGGGLVQAGDSLRLSCAASGRTFGIGTMGWFRQPPGKEREFVAAIRWSTGGTRYADSVKGRFTISRDNAKLTVDLQMDSLKPEDTAVYYCAADRLSLDLSGRYHYNPAVYDYWGQGTQVTVSSFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6416 - protein, 1115 aa, Artificial Sequence
  Synthetic Polypeptide encoding a CAR with optional accessory module(s)
MALPVTALLLPLALLLHAARPQVKLEESGGELVQPGGPLRLSCAASGNIFSINRMGWYRQAPGKQRAFVASITVRGITNYADSVKGRFTISVDKSKNTIYLQMNALKPEDTAVYYCNAVSSNRDPDYWGQGTQVTVSSGGGGSGGGGSGGGGSPVQLVESGGGLVQAGDSLRLSCAASGRTFGIGTMGWFRQPPGKEREFVAAIRWSTGGTRYADSVKGRFTISRDNAKLTVDLQMDSLKPEDTAVYYCAADRLSLDLSGRYHYNPAVYDYWGQGTQVTVSSFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6417 - protein, 973 aa, Artificial Sequence
  Synthetic Polypeptide encoding a CAR with optional accessory module(s)
MALPVTALLLPLALLLHAARPAVQLVESGGGLVQAGDSLRLTCTASGRAFSTYFMAWFRQAPGKEREFVAGIAWSGGSTAYADSVKGRFTISRDNAKNTVYLQMNSLKSEDTAVYYCASRGIEVEEFGAWGQGTQVTVSSFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6418 - protein, 974 aa, Artificial Sequence
  Synthetic Polypeptide encoding a CAR with optional accessory module(s)
MALPVTALLLPLALLLHAARPQVQLVESGGGLVQAGGSLRLSCAASGGTLSKNTVAWFRQAPGKERGFVASITWDGRTTYYADSVKGRFTISRDNAKNTVYLQMNSLKPEDTAVYVCADLGKWPAGPADYWGQGTQVTVSSFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6419 - protein, 1100 aa, Artificial Sequence
  Synthetic Polypeptide encoding a CAR with optional accessory module(s)
MALPVTALLLPLALLLHAARPAVQLVESGGGLVQAGDSLRLTCTASGRAFSTYFMAWFRQAPGKEREFVAGIAWSGGSTAYADSVKGRFTISRDNAKNTVYLQMNSLKSEDTAVYYCASRGIEVEEFGAWGQGTQVTVSSPGGGGSPQVQLVESGGGLVQAGGSLRLSCAASGGTLSKNTVAWFRQAPGKERGFVASITWDGRTTYYADSVKGRFTISRDNAKNTVYLQMNSLKPEDTAVYVCADLGKWPAGPADYWGQGTQVTVSSFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6420 - protein, 1128 aa, Artificial Sequence
  Synthetic Polypeptide encoding a CAR with optional accessory module(s)
MALPVTALLLPLALLLHAARPAVQLVESGGGLVQAGDSLRLTCTASGRAFSTYFMAWFRQAPGKEREFVAGIAWSGGSTAYADSVKGRFTISRDNAKNTVYLQMNSLKSEDTAVYYCASRGIEVEEFGAWGQGTQVTVSSPGGGGSPQVQLVESGGGLVQAGGSLRLSCAASGGTLSKNTVAWFRQAPGKERGFVASITWDGRTTYYADSVKGRFTISRDNAKNTVYLQMNSLKPEDTAVYVCADLGKWPAGPADYWGQGTQVTVSSEVAALEKEVAALEKEVAALEKEVAALEKFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6421 - protein, 1102 aa, Artificial Sequence
  Synthetic Polypeptide encoding a CAR with optional accessory module(s)
MALPVTALLLPLALLLHAARPEIVLTQSPATLSLSPGERATLSCSASSSVSYMYWYQQKPGQAPRLLIYRTSNLASGIPARFSGSGSGTDFTLTISSLEPEDFAVYYCQQYHSYPTTFGQGTKVEIKRTVGGGGSGGGGSGGGGSEVQLVESGGGLVQPGGSLRLSCAASGFSFNTYAMNWVRQAPGKGLEWVSHIRSKSNNFATYYADSVKDRFTISRDNAKNSLYLQMNSLRAEDTAVYYCARQGGDFPMDYWGQGTLVTVSSTRTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6422 - protein, 1096 aa, Artificial Sequence
  Synthetic Polypeptide encoding a CAR with optional accessory module(s)
MALPVTALLLPLALLLHAARPDVVMTQSPSSLSASVGDRVTITCKASEDIYIRLAWYQQKPGKAPKLLIYAATSLETGVPSRFSGSGSGTDFTLTISSLQPEDFATYYCQQYWTTPWTFGGGTKVEIKGGGGSGGGGSGGGGSQVQLQESGPGLVKPSQTLSLTCTVSGYSITIDYTWNWIRQPPGKGLEWIGYITYSGSTDYNPSLKSRVLISVDTSKNQVSLKLSSVTAADTAVYYCARLGRRYALDYWGQGTTVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6423 - protein, 1101 aa, Artificial Sequence
  Synthetic Polypeptide encoding a CAR with optional accessory module(s)
MALPVTALLLPLALLLHAARPDIQLTQSPSFLSASVGDRVTITCRASQGISTDLNWYQQKPGKAPKLLIYAASNLESGVPSRFSGSGSGTEFTLTISSLQPEDFATYYCQQSYNWPYTFGGGTKVEIKRGGGGSGGGGSGGGGSEVQLVESGGGLVKPGGSLRLSCAASGFTFSNFEMNWVRQAPGKGLEWVSGISSNGRYINYADSVKGRFTISRDNAKNSLYLQMNSLRAEDTAVYYCARVVDFDQDYNGFDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6424 - protein, 1099 aa, Artificial Sequence
  Synthetic Polypeptide encoding a CAR with optional accessory module(s)
MALPVTALLLPLALLLHAARPDIQLTQSPSFLSASVGDRVTITCSLSLGISTWRDWFPPRLGRGLEPLTYAASTLQSGVPSRFSGSGSGTEFTLTISSLQPEDFATYYCQQLNSYPLTFGGGTKVEIKRGGGGSGGGGSGGGGSEVQLVESGGGLVKPGGSLRLSCAASGFTFSTYGMSWVRQAPGKGLEWVAYINNGSGYIYYADSVKGRFTISRDNAKNSLYLQMNSLRAEDTAVYYCARGQWWSGGDFDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6425 - protein, 1108 aa, Artificial Sequence
  Synthetic Polypeptide encoding a CAR with optional accessory module(s)
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSRVQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6426 - protein, 1108 aa, Artificial Sequence
  Synthetic Polypeptide encoding a CAR with optional accessory module(s)
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6427 - protein, 1108 aa, Artificial Sequence
  Synthetic Polypeptide encoding a CAR with optional accessory module(s)
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6428 - protein, 1109 aa, Artificial Sequence
  Synthetic Polypeptide encoding a CAR with optional accessory module(s)
MALPVTALLLPLALLLHAARPDEIVLTQSPATLSLSPGERATLSCSASSSVSYMHWYQQKPGQAPRLLIYDTSKLASGIPARFSGSGSGTDFTLTISSLEPEDVAVYYCFQGSVYPFTFGQGTKLEIKRGGGGSGGGGSGGGGSQVQLQESGPGLVKPSQTLSLTCTVSGGSISTSGMGVGWIRQHPGKGLEWIGHIWWDDDKRYNPALKSRVTISVDTSKNQFSLKLSSVTAADTAVYYCARMELWSYYFDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6429 - protein, 1116 aa, Artificial Sequence
  Synthetic Polypeptide encoding a CAR with optional accessory module(s)
MALPVTALLLPLALLLHAARPDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6430 - protein, 1115 aa, Artificial Sequence
  Synthetic Polypeptide encoding a CAR with optional accessory module(s)
MALPVTALLLPLALLLHAARPDIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKRGGGGSGGGGSGGGGSEVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6431 - protein, 1113 aa, Artificial Sequence
  Synthetic Polypeptide encoding a CAR with optional accessory module(s)
MALPVTALLLPLALLLHAARPEIVLTQSPDFQSVTPKEKVTITCRASESVDTFGISFMNWFQQKPDQSPKLLIHAASNQGSGVPSRFSGSGSGTDFTLTINSLEAEDAATYYCQQSKEVPFTFGGGTKVEIKGGGGSGGGGSGGGGSEVQLVESGGGLVQPGGSLRLSCAASGFTFSSSWMNWVRQAPGKGLEWVGRIYPGDGDTNYNGKFKGRFTISRDDSKNSLYLQMNSLKTEDTAVYYCARSGFITTVLDFDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6432 - protein, 1109 aa, Artificial Sequence
  Synthetic Polypeptide encoding a CAR with optional accessory module(s)
MALPVTALLLPLALLLHAARPAIQLTQSPSSLSASVGDRVTITCRASQGISSAQQKPGKAPKLLILAWYSSLESGVPSRFSGYDASGSGTDFTLTISSLQPEDFATYYCQQFNSYPYTFGQGTKLEIKGGGGSGGGGSGGGGSEVQLVQSGAEVKKPGESLKISCKGSGYSFSSSWIGWVRQMPGKGLEWMGIIYPDDSDTRYSPSFQGQVTISADKSIRTAYLQWSSLKASDTAMYYCARHVTMIWGVIIDFWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6433 - protein, 1133 aa, Artificial Sequence
  Synthetic Polypeptide encoding a CAR with optional accessory module(s)
MALPVTALLLPLALLLHAARPINIYNAEPANPSEKNSPEFDIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKGGGGSGGGGSGGGGSEVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6434 - protein, 1115 aa, Artificial Sequence
  Synthetic Polypeptide encoding a CAR with optional accessory module(s)
MALPVTALLLPLALLLHAARPDILLTQSPATLSLSPGERATLSCRASQSVDYDGDSYLNWYQQKPGQPPKLLIYDASNLVSGIPPRFSGSGSGTDFTLTISRLEPEDFAVYHCQQSTEDPWTFGGGTKLEIKGGGGSGGGGSGGGGSQVQLVESGGGLVEPGGSLRLSCMSGYAFSSYWMNWVRQMPGKGLEWMGQIWPGDGDTNYNPSLKSRVTITADESTSTAYMELSSLKAEDTAVYFCARRETTTVGRYYYAMDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6435 - protein, 1112 aa, Artificial Sequence
  Synthetic Polypeptide encoding a CAR with optional accessory module(s)
MALPVTALLLPLALLLHAARPDILLTQSPATLSLSPGERATLSCRASQSVDNYGISFMNWYQQKPGQPPKLLIYAASNQGSGIPSRFSGSGSGTDFTLTISSLEPEDFAMYFCQQSNEVPRTFGGGTKLEIKGGGGSGGGGSGGGGSQVQLVESGGGLVEPGGSLRLSCMSGYAFSSSWMNWVRQMPGKGLEWMGRIYPGDGDTNYNGKFKERVTITADESTSTAYMELSSLKAEDTAVYFCARSEYWGNYWAMDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6436 - protein, 1111 aa, Artificial Sequence
  Synthetic Polypeptide encoding a CAR with optional accessory module(s)
MALPVTALLLPLALLLHAARPDILLTQSPATLSLSPGERATLSCKASQNVGTNVAWYQQKPGQPPKLLIYSATYRNSGIPARFSGSGSGTEFTLTITNVQSKDLADYFYFCQYNRYPYTSGGGTKLEIKRGGGGSGGGGSGGGGSQVQLVESGGGLVEPGGSLRLSCMSGYAFSSYWMNWVRQMPGKGLEWMGQIYPGDGDTNYNGKFKGRVTITADESTSTAYMELSSLKAEDTAVYFCARKTISSVVDFYFDNWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6437 - protein, 1124 aa, Artificial Sequence
  Synthetic Polypeptide encoding a CAR with optional accessory module(s)
MALPVTALLLPLALLLHAARPINIYNAEPANPSEKNSPEFQIVLTQSPATLSASPGEKATMTCSASSGVNYMHWYQQKPGTSPKRWIYDTDKTASGVPARFSGSGSGTSYSLTISSMEAEDAATYYCHQRGSYTFGGGTKLEIKGGGGSGGGGSGGGGSQVQLEQPGAEVVKPGASVKVSCKTSGYTFTSNWMHWVKQTPGKGLEWIGEIDPSDSYTNYNQKFDGKAKLTVDKSSSTAYMEVSDLTAEDSATYYCARGSNPYYYAMDYWGQGTSVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6438 - protein, 1110 aa, Artificial Sequence
  Synthetic Polypeptide encoding a CAR with optional accessory module(s)
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRGGGGSGGGGSGGGGSQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6439 - protein, 1118 aa, Artificial Sequence
  Synthetic Polypeptide encoding a CAR with optional accessory module(s)
MALPVTALLLPLALLLHAARPDDIQLTQSPSSLSASVGDRVTITCKASQSVDYDGDSYLNWYQQIPGKAPKLLIYDASNLVSGIPPRFSGSGSGTDYTFTISSLQPEDIATYHCQQSTEDPWTFGGGTKLQIKRGGGGSGGGGSGGGGSQVQLQQSGAEVKKPGSSVKVSCKASGYAFSSYWMNWVRQRPGQGLEWIGQIWPGDGDTNYNGKFKGRATITADESTNTAYMELSSLRSEDTAFYSCARRETTTVGRYYYAMDYWGQGTTVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6440 - protein, 1109 aa, Artificial Sequence
  Synthetic Polypeptide encoding a CAR with optional accessory module(s)
MALPVTALLLPLALLLHAARPQSVLTQPASVSGSPGQSITISCTGTSSDVGGYNYVSWYQQHPGKAPKLMIYDVNNRPSEVSNRFSGSKSGNTASLTISGLQAEDEADYYCSSYTTGSRAVFGGGTKLTVLGGGGGSGGGGSGGGGSEVQLVQSGAEVKKPGESLTISCKASGYSFPNYWITWVRQMSGGGLEWMGRIDPGDSYTTYNPSFQGHVTISIDKSTNTAYLHWNSLKASDTAMYYCARYYVSLVDIWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6441 - protein, 1115 aa, Artificial Sequence
  Synthetic Polypeptide encoding a CAR with optional accessory module(s)
MALPVTALLLPLALLLHAARPQSVVTQPPSVSAAPGQKVTISCSGSSSNIGNNYVSWYQQLPGTAPKLLIYDNNKRPSGIPDRFSGSKSGTSATLGITGLQTGDEADYYCGTWDGSLYTMLFGGGTKLTVLGGGGSGGGGSGGGGSEVQLVESGGGLVKPGGSLRLSCAASGFTFSNAWMSWVRQAPGKGLEWVGFIRSKAYGGTTEYAASVKGRFTISRDDSKSIAYLQMNNLKTEDTAVYYCARDGLYSSSWYDSDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6442 - protein, 1120 aa, Artificial Sequence
  Synthetic Polypeptide encoding a CAR with optional accessory module(s)
MALPVTALLLPLALLLHAARPQSVLTQPPSVSGAPGQRVTISCTGSSSNIGAGYDVHWYQQLPGTAPKLLIFGNSNRPSGVPDRFSGFKSGTSASLAITGLQAEDEADYFCQSYDSSLSGSGVFGTGTKVTVLGGGGGSGGGGSGGGGSQMQLVQSGGGLVQPGRSLRLSCAASGFTFDDYAMHWVRQAPGKGLEWVSGISWNSGSIGYADSVKGRFTISRDNAKNSLYLQMNSLRAEDTALYYCAKDIHSGSYYGLLYYAMDVWGQGTTVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6443 - protein, 1107 aa, Artificial Sequence
  Synthetic Polypeptide encoding a CAR with optional accessory module(s)
MALPVTALLLPLALLLHAARPDYIHVTQSPSSLSVSIGDRVTINCQTSQGVGSDLHWYQHKPGRAPKLLIHHASSVEDGVPSRFSGTGFHTSFNLTINDLQADDIGTYYCQVLQSFGRGSRLDTKGGGGSGGGGSGGGGSRAHLVQSGTAMKKPGASVRVSCQTSGYTFTAHILFWFRQAPGRGLEWVGWIKPQYGAVNFGGGFRDRVTLTRDVYREIAYMDIRGLKPDDTAVYYCARDRSYGDSSWALDAWGQGTTVVVSATRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6444 - protein, 1117 aa, Artificial Sequence
  Synthetic Polypeptide encoding a CAR with optional accessory module(s)
MALPVTALLLPLALLLHAARPDVQMIQTPDSLAVSLGQRATISCRASESVDNYGISFMHWYQQKPGQSPKLLIYRASNLESGIPARFSGSGSRTDFTLTINPVETDDVATYYCQQNNKDPPTFGGGTKLEIKGGGGSGGGGSGGGGSGGGGSQVQLQQSGAELVKPGASVKISCKASGYAFSSYWMNWVKQRPGKGLEWIGQIYPGDGDTTYNGKFKGKATLTADKSSSTVYMQLNSLTSEDSAVYFCVRYYYGSSGYFDYWGQGTTLTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6445 - protein, 1108 aa, Artificial Sequence
  Synthetic Polypeptide encoding a CAR with optional accessory module(s)
MALPVTALLLPLALLLHAARPDVQMIQTPSSLSASLGDRVTISCRASQDIGNYLNWYQQKPDGTVKLLIYYTSRLHSGVPSRFSGSGSGTEYSLTISNLEQEDIATYFCQQGSALPPTFGGGTKLEINGGGGSGGGGSGGGGSALQLQQSGAELVRPGASVTLSCKASGYTFTDYEMHWVKQTPVHGLEWIGAIDPETGGTAYNQKFEGKAILTADKSSSTAYMELRSLTSEDSPVYYCARRRYYGSSSFDYWGQGTTLTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6446 - protein, 1115 aa, Artificial Sequence
  Synthetic Polypeptide encoding a CAR with optional accessory module(s)
MRLPAQLLGLLMLWVSGSSGDVVMTQSPLSLPVTPGAPASISCRSSQSIVHSNGNTYLEWYLQKPGQSPKLLIYKVSNRFSGVPDRFSGSGSGTDFTLRISRVEAEDVGIYYCFQGSHVPPTFGPGTKLEIKGGGGSGGGGSGGGGSEVQLVESGGGLVQPGGSLRLSCSASGFTFSSFGMHWVRQAPGKGLEWVAYISSGSSTIYYGDTVKGRFTISRDNAKNSLFLQMSSLRAEDTAVYYCAREGGYYYGRSYYTMDYWGQGTTVTVSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6447 - protein, 1140 aa, Artificial Sequence
  Synthetic Polypeptide encoding a CAR with optional accessory module(s)
MALPVTALLLPLALLLHAARPARKRTQPTFGFTVNWKFSESTTVFTGQCFIDRNGKEVLKTMWLLRSSVNDIGDDWKATRVGINIFTRLRTQKEGGSGGSARKCSLTGKWTNDLGSNMTIGAVNSRGEFTGTYITAVTATSNEIKESPLHGTQNTINKSGGSTTVFTGQCFIDRNGKEVLKTMWLLRSSVNDIGDDWKATRVGINIFTRLRTQKEGGSGGSARKCSLTGKWTNDLGSNMTIGAVNSRGEFTGTYITAVTATSNEIKESPLHGTQNTINKRTQPTFGFTVNWKFSETRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6448 - protein, 1112 aa, Artificial Sequence
  Synthetic Polypeptide encoding a CAR with optional accessory module(s)
MALPVTALLLPLALLLHAARPDIVLTQSPASLAVSLGQRATISCRASKSVSTSGYSYLHWYQQKPGQPPKLLIYLASNLESGVPARFSGSGSGTDFTLNIHPVEEEDAATYYCQHSRELPFTFGSGTKLEIKGGGGSGGGGSGGGGSQVQLVESGGGLVQPGGSLKLSCAASGFDFSRYWMSWVRQAPGKGLEWIGEINPTSSTINFTPSLKDKVFISRDNAKNTLYLQMSKVRSEDTALYYCARGNYYRYGDAMDYWGQGTSVTVSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6449 - protein, 1110 aa, Artificial Sequence
  Synthetic Polypeptide encoding a CAR with optional accessory module(s)
MALPVTALLLPLALLLHAARPDIQMTQSPSSLSASVGDRVTITCSASQDISNYLNWYQQKPGKAPKLLIYYTSNLHSGVPSRFSGSGSGTDFTLTISSLQPEDFATYYCQQYRKLPWTFGQGTKLEIKRGGGGSGGGGSGGGGSQVQLVQSGAEVKKPGSSVKVSCKASGGTFSNYWMHWVRQAPGQGLEWMGATYRGHSDTYYNQKFKGRVTITADKSTSTAYMELSSLRSEDTAVYYCARGAIYDGYDVLDNWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6450 - protein, 1110 aa, Artificial Sequence
  Synthetic Polypeptide encoding a CAR with optional accessory module(s)
MALPVTALLLPLALLLHAARPDIVLTQSPATLSLSPGDRATISCRASESVTILGSHLIYWYQQKPGQPPRLLIQLASNVQTGVPARFSGSGSRTDFTLTISSVEPEDFAVYYCLQSRTIPRTFGQGTKLEIKRGGGGSGGGGSGGGGSQVQLVQSGPEVKKPGESVKISCKASGYTFRHYSMNWVKQAPGQGLKWMGRINTESGVPIYADDFKGRFSFTVDTSASTAYLEISSLTSEDTAVYFCSNDYLYSLDFWGQGTTLTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6451 - protein, 1111 aa, Artificial Sequence
  Synthetic Polypeptide encoding a CAR with optional accessory module(s)
MALPVTALLLPLALLLHAARPQSVLTQPPSVSGAPGQRVTISCTGSSSNIGAGFDVHWYQQLPGTAPKLLIYGNSNRPSGVPDRFSGSKSGTSASLAITGLQAEDEADYYCQSYDSSLSGYVFGTGTKVTVLGGGGGSGGGGSGGGGSQVQLVQSGAEVKKPGASVKVSCKASGYTFTDYYMHWVRQAPGQRLEWMGWINPNSGGTNYAQKFQDRITVTRDTSSNTGYMELTRLRSDDTAVYYCARSPYSGVLDKWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6452 - protein, 1109 aa, Artificial Sequence
  Synthetic Polypeptide encoding a CAR with optional accessory module(s)
MALPVTALLLPLALLLHAARPQAVLTQPPSASGTPGQRVTISCSGSSSNIGSYTVSWYQQLPGTAPKFLIYSNNQRPSGVPDRFSGSKSGTSASLAISGLQSEDEADYYCAAWDDSLNGYVFGTGTKVTVLGGGGGSGGGGSGGGGSEVQLVQSGAEVKKPGESLKISCKGSGYDFTTYWIGWVRQMPGKGLEWMGIIYPGDSDTRYSPSVRGRVTISADKSINTAYLQWSSLEASDTAMYYCARMWTFSQDGWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6453 - protein, 1120 aa, Artificial Sequence
  Synthetic Polypeptide encoding a CAR with optional accessory module(s)
MALPVTALLLPLALLLHAARPLPVLTQPPSASGTPGQRVTISCSGRSSNIGSNSVNWYRQLPGAAPKLLIYSNNQRPPGVPVRFSGSKSGTSASLAISGLQSEDEATYYCATWDDNLNVHYVFGTGTKVTVLGSRGGGGSGGGGSGGGGSLEMAQVQLVQSGAEVKKPGSSVKVSCKASGGTFSSYAISWVRQAPGQGLEWMGRIIPILGIANYAQKFQGRVTITADKSTSTAYMELSSLRSEDTAVYYCARGGYYSHDMWSEDWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6454 - protein, 1109 aa, Artificial Sequence
  Synthetic Polypeptide encoding a CAR with optional accessory module(s)
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKGGGGSGGGGSGGGGSQVQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6455 - protein, 1110 aa, Artificial Sequence
  Synthetic Polypeptide encoding a CAR with optional accessory module(s)
MALPVTALLLPLALLLHAARPDIVLTQSPATLSLSPGDRATLSCRASESVTILGSHLIYWYQQKPGQAPRLLIQLASNVQTGIPARFSGSGSRTDFTLTISSLEPEDFAVYYCLQSRTIPRTFGQGTKLEIKRGGGGSGGGGSGGGGSQVQLVQSGSELKKPGESVKISCKASGYTFTHYSMNWVRQAPGQGLEWMGRINTETGEPLYADDFKGRFVFSLDTSASTAYLQISSLKAEDTAVYYCSNDYLYSLDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6456 - protein, 1111 aa, Artificial Sequence
  Synthetic Polypeptide encoding a CAR with optional accessory module(s)
MALPVTALLLPLALLLHAARPDIVMTQSPDSLAVSLGERATINCKSSQSILYSSNQKNYLAWYQQKPGQSPKLLIYWASTRESGVPDRFSGSGSGTDFTLTISSLQAEDVAVYYCHQYISSYTFGQGTKLEIKGGGGSGGGGSGGGGSQVQLVQSGAEVKKPGASVKVSCKASGYTFASQWMHWMRQAPGQGLEWIGWINPGNVNTKYNEKFKGRATLTVDTSTNTAYMELSSLRSEDTAVYYCARSTWYRPLDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6457 - protein, 1235 aa, Artificial Sequence
  Synthetic Polypeptide encoding a CAR with optional accessory module(s)
MVRGVPFRHLLLVLQLALLPAATQGKKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASGGGGSGGGGSGGGGSIYQELTQLKAAVERLCHPCPWEWTFFQGNCYFMSNSQRNWHDSITACKEVGAQLVVIKSAEEQNFLQLQSSRSNRFTWMGLSDLNQEGTWQWVDGSPLLPSFKQYWNRGEPNNVGEEDCAEFSGNGWNDDKCNLAKFWICKKSAASCSRDEEQFLSPAPATPNPPPATRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6458 - protein, 1111 aa, Artificial Sequence
  Synthetic Polypeptide encoding a CAR with optional accessory module(s)
MALPVTALLLPLALLLHAARPDHIVLTQSPSSLSASLGDRVTISCRASQDISTYLNWYQQKPDGTVKLLIFYTSRLHAGVPSRFSGSGSGTHHSLTISNLEQEDIATYFCQQGNSLPFTFGSGTKLEIKRGGGGSGGGGSGGGGSQVQLKESGPELEKPGASVKISCKASGYSFTAYSMNWVKQNNGMSLEWIGSIDPYYGDTKYAQKFKGKATLTVDKASSTAYLQLKSLTSEDSAVYYCARRMITTGDWYFDVWGAGTTVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6459 - protein, 1111 aa, Artificial Sequence; identical to SEQ ID NO: 6458
  Synthetic Polypeptide encoding a CAR with optional accessory module(s)

SEQ ID NO: 6460 - protein, 1058 aa, Artificial Sequence
  Synthetic Polypeptide encoding a CAR with optional accessory module(s)
MALPVTALLLPLALLLHAARPGMRTEDLPKAVVFLEPQWYRVLEKDSVTLKCQGAYSPEDNSTQWFHNESLISSQASSYFIDAATVDDSGEYRCQTNLSTLSDPVQLEVHIGWLLLQAPRWVFKEEDPIHLRCHSWKNTALHKVTYLQNGKGRKYFHHNSDFYIPKATLKDSGSYFCRGLVGSKNVSSETVNITITQGLAVSTISSFFPPGYQTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6461 - protein, 1058 aa, Artificial Sequence; identical to SEQ ID NO: 6460
  Synthetic Polypeptide encoding a CAR with optional accessory module(s)

SEQ ID NO: 6462 - protein, 1111 aa, Artificial Sequence
  Synthetic Polypeptide encoding a CAR with optional accessory module(s)
MALPVTALLLPLALLLHAARPDEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGGGGSGGGGSGGGGSEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6463 - protein, 1113 aa, Artificial Sequence
  Synthetic Polypeptide encoding a CAR with optional accessory module(s)
MALPVTALLLPLALLLHAARPDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKRGGGGSGGGGSGGGGSQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6464 - protein, 1110 aa, Artificial Sequence
  Synthetic Polypeptide encoding a CAR with optional accessory module(s)
MALPVTALLLPLALLLHAARPDIVLTQSPAIITASPGEKVTMTCRASSSVNYMDWYQKKPGSSPKPWIYATSNLASGVPSRFSGSGSGTTYSMTISSLEAEDAATYYCQQWSFNPPTFGGGTKLEIKRGGGGSGGGGSGGGGSEVQLQQSGAELKKPGASVKVSCKASGYTFTSYNMHWVKQTPGQGLEWIGAIYPGNGDTSYNQKFKGKTTLTADKSSSTAYMELSSLRSEDTAVYYCARSNYYGSSYWFFDVWGTGTTVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6465 - protein, 1113 aa, Artificial Sequence
  Synthetic Polypeptide encoding a CAR with optional accessory module(s)
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSDWPLTFGGGTKVEIKGGGGSGGGGSGGGGSEVQLVQSGGGLVHPGGSLRLSCTGSGFTFSYHAMHWVRQAPGKGLEWVSIIGTGGVTYYADSVKGRFTISRDNVKNSLYLQMNSLRAEDMAVYYCARDYYGAGSFYDGLYGMDVWGQGTTVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6466 - protein, 1111 aa, Artificial Sequence
  Synthetic Polypeptide encoding a CAR with optional accessory module(s)
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGGGTKVEIKGGGGSGGGGSGGGGSAVQLVESGGGLVQPGRSLRLSCAASGFTFGDYTMHWVRQAPGKGLEWVSGISWNSGSIGYADSVKGRFTISRDNAKNSLYLQMNSLRAEDTALYYCTKDNQYGSGSTYGLGVWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6467 - protein, 1110 aa, Artificial Sequence
  Synthetic Polypeptide encoding a CAR with optional accessory module(s)
MALPVTALLLPLALLLHAARPDIQMTQSPSSLSASVGDRVTITCRASSSVSYMHWYQQKPGKAPKPLIYAPSNLASGVPSRFSGSGSGTDFTLTISSLQPEDFATYYCQQWSFNPPTFGQGTKVEIKRGGGGSGGGGSGGGGSEVQLVESGGGLVQPGGSLRLSCAASGYTFTSYNMHWVRQAPGKGLEWVGAIYPGNGDTSYNQKFKGRFTISVDKSKNTLYLQMNSLRAEDTAVYYCARVVYYSNSYWYFDVWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6468 - protein, 1108 aa, Artificial Sequence
  Synthetic Polypeptide encoding a CAR with optional accessory module(s)
MALPVTALLLPLALLLHAARPDIQLTQSPSSLSASVGDRVTMTCRASSSVSYIHWFQQKPGKAPKPWIYATSNLASGVPVRFSGSGSGTDYTFTISSLQPEDIATYYCQQWTSNPPTFGGGTKLEIKGGGGSGGGGSGGGGSQVQLQQSGAEVKKPGSSVKVSCKASGYTFTSYNMHWVKQAPGQGLEWIGAIYPGNGDTSYNQKFKGKATLTADESTNTAYMELSSLRSEDTAFYYCARSTYYGGDWYFDVWGQGTTVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6469 - protein, 1120 aa, Artificial Sequence
  Synthetic Polypeptide encoding a CAR with optional accessory module(s)
MALPVTALLLPLALLLHAARPSTVMTQSPDSLAVSLGERATINCKSSQSNSNDVAWYQQKPGQSPKVLIYFASNRYSGVPDRFSGSGYGTDFTLTISSLQAEDVAVYFCQQDYSSPLTFGAGTKLELKRADAGGGGSGGGGSGGGGSQIQLVQSGSELKKPGASVKVSCKASGYTFTNFGVNWVRQAPGKGLEWMGWINTYTGEPSYAQGFTGRFVFSLDASVSTAYLQISSLKAEDTATYFCTRRTNYYGTSYYYAMDYWGQGTTVTVSSAKTTTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6470 - protein, 1112 aa, Artificial Sequence
  Synthetic Polypeptide encoding a CAR with optional accessory module(s)
MALPVTALLLPLALLLHAARPQIVLSQSPAILSASPGEKVTMTCRASSSVSYMHWYQQKPGSSPKPWIYATSNLASGVPARFSGSGSGTSYSFTISRVEAEDAATYYCQQWTFNPPTFGGGTRLEIKRTVAAGGGGSGGGGSGGGGSQAYLQQSGAELVRPGASVKMSCKASGYTFTSYNMHWVKQTPRQGLEWIGGIYPGNGDTSYNQKFKGKATLTVGKSSSTAYMQLSSLTSEDSAVYFCARYDYNYAMDYWGQGTSVTVSSASTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6471 - protein, 1110 aa, Artificial Sequence; identical to SEQ ID NO: 6467
  Synthetic Polypeptide encoding a CAR with optional accessory module(s)

SEQ ID NO: 6472 - protein, 1109 aa, Artificial Sequence
  Synthetic Polypeptide encoding a CAR with optional accessory module(s)
MALPVTALLLPLALLLHAARPEIVLTQSPSSLSASVGDRVTITCRASSSLSFMHWYQQKPGKAPKPWIYATSNLASGVPSRFSGSGSGTDYTLTISSLQPEDFATYFCHQWSSNPLTFGGGTKVEIKGGGGSGGGGSGGGGSQVQLVQSGAEVKKPGASVKVSCKASGYTFTSYNMHWVRQAPGQRLEWIGAIYPGNGDTSYNQKFKGRVTVTRDTSANTAYMELSSLKSEDTAVYYCARSHYGSNYVDYFDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6473 - protein, 1111 aa, Artificial Sequence
  Synthetic Polypeptide encoding a CAR with optional accessory module(s)
MALPVTALLLPLALLLHAARPDEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGGGGSGGGGSGGGGSEVQLVESGGGLVQPDRSLRLSCAASGFTFHDYAMHWVRQAPGKGLEWVSTISWNSGTIGYADSVKGRFTISRDNAKNSLYLQMNSLRAEDTALYYCAKDIQYGNYYYGMDVWGQGTTVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6474 - protein, 1109 aa, Artificial Sequence
  Synthetic Polypeptide encoding a CAR with optional accessory module(s)
MALPVTALLLPLALLLHAARPEIVLTQSPGTLSLSPGERATLSCRASSSVPYIHWYQQKPGQAPRLLIYATSALASGIPDRFSGSGSGTDFTLTISRLEPEDFAVYYCQQWLSNPPTFGQGTKLELKRGGGGSGGGGSGGGGSEVQLVQSGAEVKKPGESLKLSCKGSGRTFTSYNMHWVRQMPGKGLEWMGAIYPLTGDTSYNQKSKLQVTISADKSISTAYLQWSSLKASDTAMYYCARSTYVGGDWQFDVWGKGTTVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6475 - protein, 1114 aa, Artificial Sequence
  Synthetic Polypeptide encoding a CAR with optional accessory module(s)
MALPVTALLLPLALLLHAARPDIQMTQSPSSLSASVGDRVTITCRSSQSIVHSVGNTFLEWYQQKPGKAPKLLIYKVSNRFSGVPSRFSGSGSGTDFTLTISSLQPEDFATYYCFQGSQFPYTFGQGTKVEIKRGGGGSGGGGSGGGGSEVQLVESGGGLVQPGGSLRLSCAASGYEFSRSWMNWVRQAPGKGLEWVGRIYPGDGDTNYSGKFKGRFTISADTSKNTAYLQMNSLRAEDTAVYYCARDGSSWDWYFDVWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6476 - protein, 1106 aa, Artificial Sequence
  Synthetic Polypeptide encoding a CAR with optional accessory module(s)
MALPVTALLLPLALLLHAARPDIVMTQSPSSLSASVGDRVTITCKASQSVTNDVAWYQQKPGKAPKLLIYYASNRYTGVPSRFSGSGSGTDFTLTISSLQPEDFATYYCQQDYRSPWTFGGGTKVEIKRGGGGSGGGGSGGGGSQVQLEESGGGVVRPGRSLRLSCAASGFTFSDYGVNWIRQAPGKGLEWVTIIWGDGRTDYNSALKSRFTVSRNNSNNTLSLQMNSLTTEDTAVYYCVRAPGNRAMEYWGQGVLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6477 - protein, 1112 aa, Artificial Sequence
  Synthetic Polypeptide encoding a CAR with optional accessory module(s)
MALPVTALLLPLALLLHAARPDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQIFGQGTKLEIKGGGGSGGGGSGGGGSQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6478 - protein, 1112 aa, Artificial Sequence
  Synthetic Polypeptide encoding a CAR with optional accessory module(s)
MALPVTALLLPLALLLHAARPQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSGGGGSGGGGSGGGGSDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQIFGQGTKLEIKTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6479 - protein, 1105 aa, Artificial Sequence
  Synthetic Polypeptide encoding a CAR with optional accessory module(s)
MALPVTALLLPLALLLHAARPDIQMTQSPATIENTSLSASVGDRVTITCRASQGISSWLTWYQQKPEKAPKSLIYAASSLQSGVPSRFSGSGSGTDFTLTISSLQPEDFATYYCQQYDSYPITFGQGTRLEIKGGGGSGGGGSGGGGSQVQLQQWGAGLLKPSETLSLTCAVYGGSFSAYYWSWIRQPPGKGLEWIGDINHGGGTNYNPSLKSRVTISVDTSKNQFSLKLNSVTAADTAVYYCASLTAYWGQGSLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6480 - protein, 1110 aa, Artificial Sequence
  Synthetic Polypeptide encoding a CAR with optional accessory module(s)
MALPVTALLLPLALLLHAARPDEIVLTQSPDSLAVSLGERATINCKASQSVDFDGDSYLNWYQQKPGQPPKVLIYAASTLQSGVPSRFSGSGSGTDFTLTINSLEAEDAATYYCQQSNEDPWTFGGGTKVEIKGGGGSGGGGSGGGGSQVQLVQSGAEVKKPGASVKVSCKVSGYTFTDYYITWVRQAPGQALEWMGWIYPGSGNTKYSQKFQGRFVFSVDTSASTAYLQLSSLKAEDTAVYYCANYGNYWFAYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6481 - protein, 1107 aa, Artificial Sequence
  Synthetic Polypeptide encoding a CAR with optional accessory module(s)
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKGGGGSGGGGSGGGGSEVQLVQSGGGLVHPGGSLRLSCAGSGFAFSSSTMHWIRQAPGKGLEWISLIGSGGGIYYGDSVKGRFTISRDNAKNSLYLQMNSLRAEDMAVYYCVRGYFDWVDYFDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6482 - protein, 1117 aa, Artificial Sequence
  Synthetic Polypeptide encoding a CAR with optional accessory module(s)
MALPVTALLLPLALLLHAARPDDIVMTQSPDSLTVSLGERTTINCKSSQSVLDSSKNKNSLAWYQQKPGQPPKLLLSWASTRESGIPDRFSGSGSGTDFTLTIDSLQPEDSATYYCQQSAHFPITFGQGTRLEIKGGGGSGGGGSGGGGSQVQLVQSGAEVKKPGASVKVSCKASGYTFTNYGMNWVKQAPGQGLKWMGWINTYTGEPTYADDFKGRVTMTSDTSTSTAYLELHNLRSDDTAVYYCARWSWSDGYYVYFDYWGQGTTVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6483 - protein, 1113 aa, Artificial Sequence
  Synthetic Polypeptide encoding a CAR with optional accessory module(s)
MALPVTALLLPLALLLHAARPDEIVLTQSPGSLAVSPGERVTMSCKSSQSVFFSSSQKNYLAWYQQIPGQSPRLLIYWASTRESGVPDRFTGSGSGTDFTLTISSVQPEDLAIYYCHQYLSSRTFGQGTKLEIKRGGGGSGGGGSGGGGSQVQLQQPGAEVVKPGASVKMSCKASGYTFTSYYIHWIKQTPGQGLEWVGVIYPGNDDISYNQKFQGKATLTADKSSTTAYMQLSSLTSEDSAVYYCAREVRLRYFDVWGQGTTVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6484 - protein, 1139 aa, Artificial Sequence
  Synthetic Polypeptide encoding a CAR with optional accessory module(s)
MALPVTALLLPLALLLHAARPYINIYNAEPANPSEKNSPTQYAYGSGEFDIQLTQSPSSLSASVGDRVTITCRASQGISSVLAWYQQKPGKAPKLLIYDASSLESGVPSRFSGSGSGTDFTLTISSLQPEDFATYYCQQFNSSITFGQGTKLEIKRTVAAGGGGSGGGGSGGGGSQVQLVQSGAEVKKPGSSVKVSCKASGGTFSDYAISWVRQAPGQGLEWMGRIIPILGVANYAQKFQGRVTITADKSTRTAYMELSSLRSEDTAVYYCARNWADAFDIWGQGTMVTVSSASTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6485 - protein, 1138 aa, Artificial Sequence
  Synthetic Polypeptide encoding a CAR with optional accessory module(s)
MALPVTALLLPLALLLHAARPYINIYNAEPANPSEKNSPTQYAYGSGEFDIVMTQSPSSLSASLGGKVTITCKASQDINKYIAWYQHKPGKGPRLLIHYTSTLQPGIPSRFSGSGSGRDYSFSISNLEPEDIATYYCLQYDNLLTFGAGTKLELKRGGGGSGGGGSGGGGSEVKLQQSGPELVKPGTSVKVSCKASGYSFTDYNMYWVKQSHGKSLEWIGYIDPYKGGTIYNQKFKGKATLTVDKSSSTAFMHLNSLTSEDSAVYYCAREMITAYYFDYWGQGSSVTVSSLERTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6486 - protein, 1154 aa, Artificial Sequence
  Synthetic Polypeptide encoding a CAR with optional accessory module(s)
MALPVTALLLPLALLLHAARPDIQMTQSPSSLSASVGDRVTINCKASQDINSYLSWFQQKPGKAPKTLIYRANRLVDGVPSRFSGSGSGQDYTLTISSLQPEDFATYYCLQYDEFPLTFGGGTKVEIKGGGGSGGGGSGGGGSQVQLVQSGAEVKKPGASVKVSCKASGYTFTNYDINWVRQAPGQGLEWIGWIYPGDGSTKYNEKFKAKATLTADTSTSTAYMELRSLRSDDTAVYYCASGYEDAMDYWGQGTTVTVSSAKPTTTPAPRPPTPAPTIASQPLSLRPEACRPAAGGAVHTRGLDFACDITRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6487 - protein, 1110 aa, Artificial Sequence
  Synthetic Polypeptide encoding a CAR with optional accessory module(s)
MALPVTALLLPLALLLHAARPEIVLTQSPLSLPVTPGEPASISCRSSQSLLHSNGYNYLDWYLQKPGQSPQLLIYLGVNSVSGVPDRFSGSGSGTDFTLKISRVEAEDVGVYYCMQALQTPWTFGQGTKVEIKGGGGSGGGGSGGGGSQVQLVQSGAEVKKPGSSVKVSCKASGGIFSNHAISWVRQAPGQGLEWMGGIIPIFGTANYAQKFQGRVTITADESTSTAFMELSSLRSEDTAVYYCAREWADVFDIWGQGTMVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6488 - protein, 1109 aa, Artificial Sequence
  Synthetic Polypeptide encoding a CAR with optional accessory module(s)
MALPVTALLLPLALLLHAARPDIQMTQSPASLTVSLGQRATISCRASESVDSYGNSYLHWYQQKPGQPPQLLIYLASNLESGVPARFSGSGSRTDFTLTIDPVEADDAATYYCQQNNEDPWTFGGGTKVEIKGGGGSGGGGSGGGGSEVQLQQSGAELVKPGASVKMSCKAFGYTFTTFPIEWMKQSHGKSLEWIGNFHPYNDQTKYNEEFKGRAKLTIDRSSSTVYLELGRLTSDDSAVYYCARGYYYAFDFWGQGTTLTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6489 - protein, 1106 aa, Artificial Sequence
  Synthetic Polypeptide encoding a CAR with optional accessory module(s)
MALPVTALLLPLALLLHAARPDIQMTQSPSSLSASVGDRVTITCRASQGIRNDLGWYQQKPGKAPKRLIYAASSLQSGVPSRFSGSGSGTEFTLTISSLQPEDFATYYCLQHNSYPWTFGQGTKLEIKGGGGSGGGGSGGGGSEVQLVESGGALIQPGGSLRLSCVASGFTISGNYMSWVRQAPGKGLEWVSLIYSGDSTYYADSVKGRFTISRDISKNTVYLQMNSLRVEDTAVYYCVRDGYYVSDMVVWGKGTTVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6490 - protein, 1116 aa, Artificial Sequence
  Synthetic Polypeptide encoding a CAR with optional accessory module(s)
MALPVTALLLPLALLLHAARPDVLLTQSPLSLPVTLGQPASISCRSSQTIVHSNGNTYLEWFQQRPGQSPRLLIYQVSNRFSGVPDRFSGSGSGTDFTLKISRVEAEDVGVYYCFQGSHVPRTFGGGTKVEIKRGGGGSGGGGSGGGGSQIQLVQSGSELKKPGASVKVSCKASGYTFTNYGMNWVRQAPGQGLKWMGWINTNTGEPKYAEEFKGRFALSLDTSVSTAYLQINSLKAEDTAVYFCARGYGNYARGAWLAYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6491 - protein, 1103 aa, Artificial Sequence
  Synthetic Polypeptide encoding a CAR with optional accessory module(s)
MALPVTALLLPLALLLHAARPDEIVLTQSPATLSLSPGERATLSCSASSSINYIYWLQQKPGQAPRILIYLTSNLASGVPARFSGSGSGTDFTLTISSLEPEDFAVYYCLQWSSNPLTFGGGTKVEIKGGGGSGGGGSGGGGSFEVQLVESGGGLVKPGGSLRLSCAASGFTFSSYDMSWVRQAPGKGLEWVSTISSGGSYTYYLDSIKGRFTISRDNAKNSLYLQMNSLRAEDTAVYYCARQGLDYWGRGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6492 - protein, 1111 aa, Artificial Sequence
  Synthetic Polypeptide encoding a CAR with optional accessory module(s)
MALPVTALLLPLALLLHAARPDIVMTQSPDSLAVSLGERATINCRASKSVSTSGYSFMHWYQQKPGQPPKLLIYLASNLESGVPDRFSGSGSGTDFTLTISSLQAEDVAVYYCQHSREVPWTFGQGTKVEIKRGGGGSGGGGSGGGGSQVQLVQSGAEVKKPGASVKVSCKASGYTFTNYGMNWVRQAPGQGLEWMGWINTYTGEPTYADAFKGRFAFSLDTSTSTAYLQINSLRSDDTAVYYCARDYGDYGMDYWGQGTTVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6493 - protein, 1107 aa, Artificial Sequence
  Synthetic Polypeptide encoding a CAR with optional accessory module(s)
MALPVTALLLPLALLLHAARPDIVMTQTPLTLSVTIGQPASISCKSSQSLLDSDGKTYLNWLLQRPGQSPERLIYLVSKLDSGVPDRFTGSGSGTDFTLKISRVEAEDLGVYCCWQGTHFPYTFGGGTKVEIKGGGGGSGGGGSGGGGSQVQLQQPGAELVRPGASVKLSCKASGYTFTSYWMNWVKQRPGQGLEWIGMIDPSDSETHYNHIFKDKATLTVDKSSSTAYLQLSSLTSEDSAVYYCARNLYLWGQGTSVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6494 - protein, 1111 aa, Artificial Sequence
  Synthetic Polypeptide encoding a CAR with optional accessory module(s)
MALPVTALLLPLALLLHAARPDDIQLTQSPSSLSASVGDRVTITCKASQSVDYEGDSFLNWYQQKPGKAPKLLIYAASNLESGVPSRFSGSGSGTDFTLTISSLQPEDFATYYCQQSNEDPLTFGQGTKVEIKRGGGGSGGGGSGGGGSEVQLVESGGGLVQPGGSLRLSCAASGYTFSSYWIEWVRQAPGKGLEWIGEILPGGGDTNYNEIFKGRATFSADTSKNTAYLQMNSLRAEDTAVYYCTRRVPIRLDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6495 - protein, 1107 aa, Artificial Sequence
  Synthetic Polypeptide encoding a CAR with optional accessory module(s)
MALPVTALLLPLALLLHAARPDIVMTQTPLSLSVTPGQPASISCKSSQSLLDGDGKTYLNWLLQKPGQSPQRLIYLVSKLDSGVPDRFSGSGSGTDFTLKISRVEAEDVGVYYCWQGTHFPRTFGQGTKLEIKGGGGSGGGGSGGGGSQVQLVQSGAEVKKPGASVKVSCKASGYTFKDTYIHWVRQAPGQGLEWMGRIDPANGNTKYDPKFQGRVTMTRDTSISTAYMELSRLRSDDTAVYYCARRGGVDWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6496 - protein, 1115 aa, Artificial Sequence
  Synthetic Polypeptide encoding a CAR with optional accessory module(s)
MALPVTALLLPLALLLHAARPDIVMTQSPDSLAVSLGERATINCESSQSLLNSGNQKNYLTWYQQKPGQPPKPLIYWASTRESGVPDRFSGSGSGTDFTLTISSLQAEDVAVYYCQNDYSYPYTFGQGTKLEIKRGGGGSGGGGSGGGGSEVQLVQSGAEVKKPGESLKISCKGSGYSFTDYYMKWARQMPGKGLEWMGDIIPSNGATFYNQKFKGQVTISADKSISTTYLQWSSLKASDTAMYYCARSHLLRASWFAYWGQGTMVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6497 - protein, 1110 aa, Artificial Sequence
  Synthetic Polypeptide encoding a CAR with optional accessory module(s)
MALPVTALLLPLALLLHAARPDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKGGGGSGGGGSGGGGSQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6498 - protein, 1114 aa, Artificial Sequence
  Synthetic Polypeptide encoding a CAR with optional accessory module(s)
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKGGGGSGGGGSGGGGSEVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6499 - protein, 1114 aa, Artificial Sequence
  Synthetic Polypeptide encoding a CAR with optional accessory module(s)
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKGGGGSGGGGSGGGGSQVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6500 - protein, 1108 aa, Artificial Sequence
  Synthetic Polypeptide encoding a CAR with optional accessory module(s)
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQDYGFPWTFGQGTKVEIKRGGGGSGGGGSGGGGSEVQLVQSGAEVKKPGESLKISCKGSGYSFTSYWISWVRQMPGKGLEWMGIIDPSDSDTRYSPSFQGQVTISADKSISTAYLQWSSLKASDTAMYYCARGDGSTDLDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6501 - protein, 1110 aa, Artificial Sequence
  Synthetic Polypeptide encoding a CAR with optional accessory module(s)
MALPVTALLLPLALLLHAARPQFVLTQPPSVSTNPGSTVKLSCKRNTGNIGSNYVNWYQQKPGQSPTTMIYRDDKRPDGVPDRFSGSIDRSSNSALLTINNVQTEDEADYFCQSYSSGINIIFGGGTKLTVLGGGGSGGGGSGGGGSQVQLQESGPGLVKPSETLSLTCTVSGFSLTTYDVHWVRQPPGKGLEWMGRIQNAGITDYNSALKSRLIISRDTSKSQVFLKMNSVTTADTAMYFCAKTGSYFYAFDHWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6502 - protein, 1107 aa, Artificial Sequence
  Synthetic Polypeptide encoding a CAR with optional accessory module(s)
MALPVTALLLPLALLLHAARPDIQMTQSPASLSASLGETVTIECRPSEDIHSNVAWYQQKPGNSPQLLIYDASNLADGVPSRFSGSGSGTQYSLKINSLQSEDVASYFCHQYNIYPYTFGSGTKLELKGGGGSGGGGSGGGGSQVQLQESGPTLVKPGDSVKMSCKASGYTFTDYIIHWVKQSHGKSLEWIGYINPYSDGTNYNEKFKSKATLTVDKSTSTAYMEFSRLTSEDSAIYFCALNYGSYYAMDAWGQGTSVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6503 - protein, 1108 aa, Artificial Sequence
  Synthetic Polypeptide encoding a CAR with optional accessory module(s)
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGQGTKVEIKRGGGGSGGGGSGGGGSEVQLLESGGGLVQPGGSLRLSCAASGFTFSGYWMHWVRQAPGKGLEWVSAIRSDGSSKYYADSVKGRFTISRDNSKNTLYLQMNSLRAEDTAVYYCAKDGVIEDTFDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6504 - protein, 1104 aa, Artificial Sequence
  Synthetic Polypeptide encoding a CAR with optional accessory module(s)
MALPVTALLLPLALLLHAARPDVQITQSPSYLAASPGETITINCRASKSISKDLAWYQEKPGKTNKLLIYSGSTLQSGIPSRFSGSGSGTDFTLTISSLEPEDFAMYYCQQHNKYPYTFGGGTKLEIKRGGGGSGGGGSGGGGSQVQLQQPGAELVRPGASVKLSCKASGYTFTSYWMNWVKQRPDQGLEWIGRIDPYDSETHYNQKFKDKAILTVDKSSSTAYMQLSSLTSEDSAVYYCARGNWDDYWGQGTTLTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6505 - protein, 1135 aa, Artificial Sequence
  Synthetic Polypeptide encoding a CAR with optional accessory module(s)
MALPVTALLLPLALLLHAARPYINIYNAEPANPSEKNSPTQYAYGSGEFDIQMTQSPASLSASLGETVTIECRTSKDIYSNLAWFQQEPGNSPQLLIYDASNLADGVPSRFSGSGSGTQYSLQINNLQSEDVASYFCHQYNNYPYTFGTGTKLELKGGGGSGGGGSGGGGSQVQLQESGPTLVNPGDSVKMSCKASGYTFTDHIIHWVKQSHGKSLEWIGYINPYSGGANYNGKFKSKATLTIDKSSSTAYMEFSRLTSGDSAIYYCALNYGSYYAMDAWGQGTSVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6506 - protein, 1106 aa, Artificial Sequence
  Synthetic Polypeptide encoding a CAR with optional accessory module(s)
MALPVTALLLPLALLLHAARPEIVLTQSPTSMTASPGEQVTITCRASSSINYMHWYQQKPGASPRPWIYETSKLASGVPDRFSGSASGTSYSLTINNMEAEDAATYYCQQWNYPSWTFGGGTKLELKGGGGSGGGGSGGGGSEVQLVESGGGLVQPGRSLKLSCAASGFTFSDYNMAWVRQAPKKGLEWVATILYDGGRTYYRGSVKGRFTISRDNAKSTLYLRMDSLRSEDTATYYCATHSRGTDYFDYWGQGVMVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6507 - protein, 1115 aa, Artificial Sequence
  Synthetic Polypeptide encoding a CAR with optional accessory module(s)
MALPVTALLLPLALLLHAARPDIVMTQSPSSLAVSEGETVTINCKSSQSFLSSGDGKNYVAWYQYKPGQSPKLLIYWASTRQSGVPDRFIGSGSGTDFTLTISTVQAEDLAIYYCQQYYDTPLTFGSGTKLEIKGGGGSGGGGSGGGGSEVKLQESGPSLVQSSQTLSLTCTVSGFSLTSYHIHWVRQTPGKGLEWMGVMWSDGDTSYNSALKSRLSISRDTSQSQVFLKMNSLQTEDTATYYCARGYYSSYLYLWFAYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6508 - protein, 1119 aa, Artificial Sequence
  Synthetic Polypeptide encoding a CAR with optional accessory module(s)
MALPVTALLLPLALLLHAARPDVLMTQTPVSLPVSLGGQVSISCRSSQSLVHSDGDTYLHWYLQKPGQSPQLLIYRVSNRFSGVPDRFSGSGSGTDFTLKISRVEPEDLGLYYCLQTTHFPPWTFGGGTKLEMKGGGGSGGGGSGGGGSQVQLQQSGPELRRPGSSVRLSCKASGYRIKDFLIHWIKNRPEHGLEWIGWIDPEDGETKYAQKFQTKATLTADTSSNTAYMQLSSLTSEDTATYFCARWGDVYYGLMRGHVMDAWGQGTSVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6509 - protein, 1110 aa, Artificial Sequence
  Synthetic Polypeptide encoding a CAR with optional accessory module(s)
MALPVTALLLPLALLLHAARPDIQMTQSTSSLSASLGDRVTISCSASQGINNYLNWYQQKPDGTVELLIYYTSTLQSGVPSRFSGSGSGTDYSLTISNLEPEDIGTYYCQQYSKLPRTFGGGTKLEIKGGGGSGGGGSGGGGSQVQLQQSGSELMMPGASVKISCKATGYTFSNYWIEWVKQRPGHGLEWIGEILPGTGRTIYNEKFKGKATFTADISSNTVQMQLSSLTSEDSAVYYCARRDYYGNFYYAMDYWGQGTSVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6510 - protein, 1105 aa, Artificial Sequence
  Synthetic Polypeptide encoding a CAR with optional accessory module(s)
MALPVTALLLPLALLLHAARPDIQMTQSPASLSVSVGETVTITCRASENIYSNLAWYQQKQGKSPQLLVYAATNLADGVPSRFSGSGSGTQYSLKINSLQSEDFGSYYCQHFWGTWTFGGGTTLEIKGGGGSGGGGSGGGGSEVQLQQSGPELVKPGASVKMSCKASGYTFTDYYMKWMKQSHGKSLEWIGDINPNNGGTTYNQKFKGKATLTVDKSSSTAYMQLNSLTSEDSAVYYCARDYGYGYFDYWGQGTTLTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6511 - protein, 1108 aa, Artificial Sequence
  Synthetic Polypeptide encoding a CAR with optional accessory module(s)
MALPVTALLLPLALLLHAARPEIVLTQSPGTLSLSPGERATLSCRASQSVGGYLAWYQQKPGQAPRLLIYDASNRATGIPARFSGSGSGTDFTLTISSLEPEDFAVYYCQQRNNWPPMYTFGQGTKLEIKRGGGGSGGGGSGGGGSQVQLVQSGAEVKKPGSSVKVSCKASGGTFSSYAISWVRQAPGQGLEWMGGIIPILGTANYAQKFQGRVTITADESTSTAYMELSSLRSEDTAVYYCARWGGGAFDIWGQGTMVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6512 - protein, 1103 aa, Artificial Sequence
  Synthetic Polypeptide encoding a CAR with optional accessory module(s)
MALPVTALLLPLALLLHAARPQIVLTQSPALMSASPGEKVTMTCSASSSVRYMYWYQQKPRSSPKPWIHLTSNLASGVPARFSGSGSGTSYSLTISSMEAEDAATYYCQQWSSHPFTFGSGTKLEIKGGGGSGGGGSGGGGSDVQLQESGPGLVKPSQSLSLTCTVTGFSITSDYSWNWIRQFPGNKLEWMGYISYSGHTSYNPSLESRISITRDTSKNQFFLQLNSVTTEDTATYYCTRGNWDVVYWGQGTLVTVSATRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6513 - protein, 1113 aa, Artificial Sequence
  Synthetic Polypeptide encoding a CAR with optional accessory module(s)
MALPVTALLLPLALLLHAARPDVVMTQSPLSLPVTLGQPASISCRSSQSIVHSDGNTYLEWYQQRPGQSPRRLIYKVSNRFSGVPDRFSGSGSGTDFTLKISRVEAEDVGVYYCFQGSHAPWTFGGGTKVEIKGGGGSGGGGSGGGGSEVQLVESGGGLVQPGGSLRLSCAASGFTFSSYGMHWVRQAPGKGLEWVAYITTRSSTIYYADSVKGRFTISRDNAKNSLYLQMNSLRAEDTAVYYCTREPLTGYYAMDYWGQGTSVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6514 - protein, 1105 aa, Artificial Sequence
  Synthetic Polypeptide encoding a CAR with optional accessory module(s)
MALPVTALLLPLALLLHAARPDIQMTQSPSSLSASVGDRVTITCRASQSISLWLNWYQQKPGKAPKLLIYAASTLQSGVPSRFSGSGSGTDFTLTISSLQPEDFATYYCQQYYTSPYTFGQGTKVEIKRGGGGSGGGGSGGGGSQVQLLESGGGLVQPGGSLRLSCAASGFTFSSYAMSWVRQAPGKGLEWVSVIRSSGSSTYYADSVKGRFTISRDNSKNTLYLQMNSLRAEDTAVYYCARGGGYFDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6515 - protein, 1108 aa, Artificial Sequence
  Synthetic Polypeptide encoding a CAR with optional accessory module(s)
MALPVTALLLPLALLLHAARPDIQMTQSPSSLSASVGDRVTITCRASQSISSYLNWYQQKPGKAPKLLIYAVSTLQSGVPSRFSGSGSGTDFTLTISSLQPEDFATYYCQQSGTFPPTTFGQGTKVEIKRGGGGSGGGGSGGGGSQVQLLESGGGLVQPGGSLRLSCAASGFTFSSHGMHWVRQAPGKGLEWVSVISGSGSNTGYADSVKGRFTISRDNSKNTLYLQMNSLRAEDTAVYYCARQWGSYAFDSWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6516 - protein, 1118 aa, Artificial Sequence
  Synthetic Polypeptide encoding a CAR with optional accessory module(s)
MALPVTALLLPLALLLHAARPDIVMSQSPSSLAVSVGEKVTMSCKSSQSLLHSSNQKNYLAWYQQKPGQSPKVLIYWASTRESGVPDRFTGSGSGTDFTLTITSVKSEDLAVYYCQQYYSYPWTFGGGTRLEIKRGGGGSGGGGSGGGGSEVQLQQSVAELVKPGASVKMSCKVSGYTLTDHTIHWMKQRPEQGLEWIGYIYPRDGITGYNEKFKGKATLTADTSSSTAYMQLNSLTSEDSAVYFCARWGYSYRNYAYYYDYWGQGTTLTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6517 - protein, 1115 aa, Artificial Sequence
  Synthetic Polypeptide encoding a CAR with optional accessory module(s)
MALPVTALLLPLALLLHAARPEIVLTQSPGTLSLSPGERATLSCRASQSVSSSYLAWYQQKPGQAPRLLIYGTSSRATGIPDRFSGSGSGTDFTLTISRLEPEDFAVYYCQQYGSSPFTFGGGTKVEIKRGGGGSGGGGSGGGGSQVQLQESGPGLAKPSETLSLTCTVSGDSITSYYWSWIRQPPGKGLEWIGYIYYSGSTNYNPSLKSRVTISVDTSKNQFSLKLSSVTAADTAVYYCARDQRRIAAAGTHFYGMDVWGQGTTVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6518 - protein, 1107 aa, Artificial Sequence
  Synthetic Polypeptide encoding a CAR with optional accessory module(s)
MALPVTALLLPLALLLHAARPDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKGGGGSGGGGSGGGGSQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSATRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6519 - protein, 1100 aa, Artificial Sequence
  Synthetic Polypeptide encoding a CAR with optional accessory module(s)
MALPVTALLLPLALLLHAARPMTQSPKFLLVSAGDRVTLTCKASQSVNNDVYWYQQEPGQSPKLLIYWASTRESGVPDRFTGSGSGTDFTLTISSVQAEDLAVYYCKQSYNLYTFGGGTKLEIKRGGGGSGGGGSGGGGSESGRGLVQPGGSRKLSCAASGFTFSTSGMHWVRQAPEKGLEWVAYISSGSTTIYHADTVKGRFTISRDNPKNTLFLQMTSLRSEDTAMYYCCARSGQFGNYFDYWGQGTTLTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6520 - protein, 1105 aa, Artificial Sequence
  Synthetic Polypeptide encoding a CAR with optional accessory module(s)
MALPVTALLLPLALLLHAARPQSPSSLAVSAGEKVTMSCKSSQSLLNSRTRKNYLAWYQQKPGQSPKLLIYWASTRESGVPDRFTGSGSGTDFTLTISSVQAEDLAVYYCKQSNLYTFGGGTKLEIKGGGGSGGGGSGGGGSQVQLEESGPELVKPGASVKLSCKASGYTFTEYIIHWVKQRSGQGLEWIGWFYPGSGSIKYNEKFKDKATLTADKSSSTVYMELSGLTSEDSAVYFCARHDGYSYFDYWGQGTTLTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6521 - protein, 1117 aa, Artificial Sequence
  Synthetic Polypeptide encoding a CAR with optional accessory module(s)
MEMFQGLLLLLLLSMGGTWASREMLRPRCRPINATLAVEKEGCPVCITVNTTICAGYCPTMTRVLQGVLPALPQVVCNYRDVRFESIRLPGCPRGVNPVVSYAVALSCQCALCRRSTTDCGGPKDHPLTCDDPRFQASSSSKAPPPSLPSPSRLPGPSDTPILPQGGGGSGGGGSGGGGSAPDVQDCPECTLQENPFFSQPGAPILQCMGCCFSRAYPTPLRSKKTMLVQKNVTSESTCCVAKSYNRVTVMGGFKVENHTACHCSTCYYHKSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6522 - protein, 1108 aa, Artificial Sequence
  Synthetic Polypeptide encoding a CAR with optional accessory module(s)
MALPVTALLLPLALLLHAARPDIQMTQSPSSLSASLGERVSLTCRATQELSGYLSWLQQKPDGTIKRLIYAASTLDSGVPKRFSGNRSGSDYSLTISSLESEDFADYYCLQYAIYPYTFGGGTKLEIKGGGGSGGGGSGGGGSEVQLQQSGPELVKPGASVKMSCKASGYTFTSYFIHWVKQKPGQGLEWIGFINPYNDGSKYNEKFKGKATLTSDKSSSTAYMELSSLTSEDSAVYYCTRDDGYYGYAMDYWGQGTSVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6523 - protein, 1113 aa, Artificial Sequence
  Synthetic Polypeptide encoding a CAR with optional accessory module(s)
MALPVTALLLPLALLLHAARPDTIVLTQSPASLAVSLGQRATISCRASESVDSYGNSFMHWYQQKPGQPPKLLIYLASNLESGVPARFSGSGSRTDFTLTIDPVEADDAATYYCQQNNYDPWTFGGGTKLEIKGGGGSGGGGSGGGGSEVQLQQSGPELVKPGASVKMSCKASGYTFTSYVMHWVKQKPGQGLEWIGYINPYNDGTKYNEKFKGKATLTSDTSSSTAYMELNSLTSEDSAVYFCARPIYFDNDYFDYWGQGTTLKVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6524 - protein, 1108 aa, Artificial Sequence
  Synthetic Polypeptide encoding a CAR with optional accessory module(s)
MALPVTALLLPLALLLHAARPDIQMTQSPSSLSASVGDRVTITCKASQDVSTAVAWFQQKPGKAPKLLIYSPSYRYTGVPSRFSGSGSGTDFTLTISSLQPEDFTYYCQQLYSTPYTFGQGTKVEIKGGGGSGGGGSGGGGSEVQLVQSGAEVKKPGASVKVSCKASGYTFTDYYLDVVVRQAPGQGLEWIGRVNPYNGGTIYNQKFKGRVTLTRDTSTSTAYLELSSLRSEDTAVYYCARDHYRYDPLLDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6525 - protein, 1114 aa, Artificial Sequence
  Synthetic Polypeptide encoding a CAR with optional accessory module(s)
MALPVTALLLPLALLLHAARPDIQMTQSPSSLSASVGDRVTITCRASQSVSTSSYNYMHWYQQKPGKPPKLLIKYASNLESGVPSRFSGSGSGTDFTLTISSLQPEDFATYYCQHSWEIPLTFGQGTKVEIKGGGGSGGGGSGGGGSEVQLVQSGAEVKKPGASVKVSCKASGYSFTDYYMHWVRQAPGQGLEWIGRINPYNGAAFYSQNFKDRVTLTVDTSTSTAYLELSSLRSEDTAVYYCAIERGADLEGYAMDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6526 - protein, 1112 aa, Artificial Sequence
  Synthetic Polypeptide encoding a CAR with optional accessory module(s)
MALPVTALLLPLALLLHAARPEIVLTQSPATLSASPGERVTLTCRASSNVISSYVHWYQQKPGSSPRLFLYSTSNLASGVPSRFSGSGSGTDFTFTISSLEAEDAATYYCQQYSGYPLTFGQGTRLEIKGGGGSGGGGSGGGGSQVQLQESGPGLVKPSETLSLTCAVSGYSITSAYYWNWIRQPPGKGLEWIGYISYDGRNNYNPSLKNRITINPDTSKNQFSLQLNSVTPEDTAVYYCAREGDYDVGNYYAMDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6527 - protein, 1112 aa, Artificial Sequence
  Synthetic Polypeptide encoding a CAR with optional accessory module(s)
MALPVTALLLPLALLLHAARPEIVLTQSPATLSLSPGERATLSCRASSNVISSYVHWYQQKPGQAPRLLIYSTSNLASGIPARFSGSGSGTDFTLTISSLEPEDFAVYYCQQYSGYPLTFGQGTRLEIKGGGGSGGGGSGGGGSEVQLVESGGGLVQPGRSLRLSCAASGYSITSAYYWNWVRQAPGKGLEWVSYISYDGRNNYNPSLKNRFTISRDNAKKSLYLQMNSLRAEDTALYYCAKEGDYDVGNYYAMDYWGQGTTVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6528 - protein, 1124 aa, Artificial Sequence
  Synthetic Polypeptide encoding a CAR with optional accessory module(s)
MALPVTALLLPLALLLHAARPDLNFMLTQPHSVSGSPGKTVTISCTRSTGSITSNYVHWYQQRPGSSPTTVICEDNERPSGVPDRFSGSIDISSNSASLTISGLKTEDEADYYCQSYDDSNHISVFGTGTKVTVLGQPKANPGGGGSGGGGSGGGGSQVQLQESGPGLVKPSETLSLTCTVSGGSISSSNYYWGWIRQPPGKGLEWIGAIYYSGSTYYNPSLKSRVAISVDTSKNQFSLKLSSVTAADTAVYYCARRIGVAGQWYFDLWGRGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6529 - protein, 1110 aa, Artificial Sequence
  Synthetic Polypeptide encoding a CAR with optional accessory module(s)
MALPVTALLLPLALLLHAARPDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKGGGGSGGGGSGGGGSQIQLVQSGPDLKKPGETVKISCKASGYTFTNTGMNWVKQAPGKGLKWMGWINTYTGEPTYADDFKGRFTFSLETSASTAYLQINNLKNEDTATYFCTRWGYGSSLYYAMDYWGQGTSVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6530 - protein, 1107 aa, Artificial Sequence
  Synthetic Polypeptide encoding a CAR with optional accessory module(s)
MALPVTALLLPLALLLHAARPDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKGGGGSGGGGSGGGGSEVQLVESGGGLVQPGGSLRLSCAASGFDFSRYWMSWVRQAPGKGLEWIGEINPDSSTINYAPSLKDKFIISRDNAKNSLYLQMNSLRAEDTAVYYCARPDGNYWYFDVWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6531 - protein, 1108 aa, Artificial Sequence
  Synthetic Polypeptide encoding a CAR with optional accessory module(s)
MALPVTALLLPLALLLHAARPDIVMTQSQKSMSTSVGDRVSITCKASQDVITGVAWYQQKPGQSPKLLIYSASYRYTGVPDRFTGSGSGTDFTFTISNVQAEDLAVYYCQQHYSTPLTFGAGTKLELKGGGGSGGGGSGGGGSQVQLQQPGAELVRPGASVKLSCKASGYSFTTYWMNWVKQRPGQGLEWIGMIHPSDSETRLNQKFKDKATLTVDKSSSTAYMQLSSPTSEDSAVYYCARSTMIATRAMDYWGQGTSVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6532 - protein, 1110 aa, Artificial Sequence
  Synthetic Polypeptide encoding a CAR with optional accessory module(s)
MALPVTALLLPLALLLHAARPDIQMTQSPSSLSASVGDRVTITCKASQDVSTAVAWYQQKPGKAPKLLIYSASYRYTGVPDRFTGSGSGTDFTLTISSLQPEDFATYYCQQHYSTPPYTFGGGTKVEIKRGGGGSGGGGSGGGGSQVQLVQSGAEVKKPGASVKVSCKASGYAFSSSWMNWVRQAPGQGLEWIGRIYPGDGDTKYNGKFKGKATLTADKSTSTAYMELSSLRSEDTAVYYCARSTMIATGAMDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6533 - protein, 1111 aa, Artificial Sequence
  Synthetic Polypeptide encoding a CAR with optional accessory module(s)
MALPVTALLLPLALLLHAARPDVVMTQTPLSLSVTPGQPASISCRSSQSLVHNNGNTYLHWYLQKPGQSPQLLIYKVSNRFSGVPDRFSGSGSGTDFTLKISRVEAEDVGVYFCSQSTHVPPYTFGGGTKVEIKGGGGSGGGGSGGGGSEVQLVESGGGLVQPGGSLRLSCAASGFTFSDYYMAWVRQAPGKGLEWVAEINYDGSSTYYVDSVKGRFTISRDNAKNSLYLQMNSLRAEDTAVYYCARDRGFYFDYWGQGTTVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6534 - protein, 1111 aa, Artificial Sequence
  Synthetic Polypeptide encoding a CAR with optional accessory module(s)
MALPVTALLLPLALLLHAARPDVVMTQTPLSLSVTPGQPASISCRSSQSLVHSNGLTYLHWYLQKPGQSPQLLIYKVSNRFSGVPDRFSGSGSGTDFTLKISRVEAEDVGVYFCSQSTHVPPFTFGGGTKVEIKGGGGSGGGGSGGGGSEVQLVESGGGLVQPGGSLRLSCAASGFTFSDYYMAWVRQAPGKGLEWVASINYDGESTYYVDSVKGRFTISRDNAKNSLYLQMNSLRAEDTAVYYCARDRGYYFDYWGQGTTVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6535 - protein, 1111 aa, Artificial Sequence
  Synthetic Polypeptide encoding a CAR with optional accessory module(s)
MALPVTALLLPLALLLHAARPDVVMTQSPLSLPVTPGEPASISCRSSQSLVHSNGNTYLHWYLQKPGQSPQLLIYKVSNRFSGVPDRFSGSGSGTDFTLKISRVEAEDVGVYFCSQSTHVPPFTFGGGTKVEIKGGGGSGGGGSGGGGSEVQLVESGGGLVQPGGSLRLSCAASGFTFSDYYMAWVRQAPGKGLEWVADINYDGGSTYYLDSLKSRFTISRDNAKNSLYLQMNSLRAEDTAVYYCARDRGYYFDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6536 - protein, 1109 aa, Artificial Sequence
  Synthetic Polypeptide encoding a CAR with optional accessory module(s)
MALPVTALLLPLALLLHAARPDIQMTQSSSYLSVSLGGRVTITCKASDHINNWLAWYQQKPGNAPRLLISGATSLETGVPSRFSGSGSGKDYTLSITSLQTEDVATYYCQQYWSTPWTFGGGTKLEIKGGGGSGGGGSGGGGSQVQLQQSGAELARPGASVKLSCKASGYTFTSYWMQWVKQRPGQGLEWIGAIYPGDGDTRYTQKFKGKATLTADKSSSTAYMQLSSLASEDSAVYYCARGKVYYGSNPFAYWGQGTLVTVSATRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6537 - protein, 1109 aa, Artificial Sequence
  Synthetic Polypeptide encoding a CAR with optional accessory module(s)
MALPVTALLLPLALLLHAARPDIVMTQSHKFMSTSVGDRVSITCKASQDVSTAVAWYQQKPGQSPKLLIYSASYRYTGVPDRFTGSGSGTDFTFTISSVQAEDLAVYYCQQHYSTPPYTFGGGTKLEIKGGGGSGGGGSGGGGSQVQLQQSGPELVKPGASVKISCKASGYAFSSSWMNWVKQRPGQGLEWIGRIYPGDGDTKYNGKFKGKATLTADKSSSTAYMQLSSLTSVDSAVYFCARSTMIATGAMDYWGQGTSVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6538 - protein, 1114 aa, Artificial Sequence
  Synthetic Polypeptide encoding a CAR with optional accessory module(s)
MALPVTALLLPLALLLHAARPQSVLTQPPSVSGAPGQRVTISCTGSGSNIGAPYDVSWYQQLPGTAPKLLIYHNNKRPSGVPDRFSGSKSGTSASLAITGLQAEDEADYYCATVEAGLSGSVFGGGTKLTVLGAGGGGSGGGGSGGGGSQVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSPLTLGLWGQGTMVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6539 - protein, 1114 aa, Artificial Sequence
  Synthetic Polypeptide encoding a CAR with optional accessory module(s)
MALPVTALLLPLALLLHAARPQSVLTQPPSVSGAPGQRVTISCTGSGSNIGAPYDVSWYQQLPGTAPKLLIYHNNKRPSGVPDRFSGSKSGTSASLAITGLQAEDEADYYCQSYDSSSISTIFGGGTKLTVLGAGGGGSGGGGSGGGGSQVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSGIAYRPWGQGTMVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6540 - protein, 1125 aa, Artificial Sequence
  Synthetic Polypeptide encoding a CAR with optional accessory module(s)
MALPVTALLLPLALLLHAARPDEFEVQLVESGGGLVQAGGSLRLSCVASGISSSKRNMGWYRQAPGKQRESVATISSGGNKDYTDAVKDRFTISRDTTKNTVYLQMNSLKPEDTAVYYCKIEAGTGWATRRGYTYWGQGTLVTVSSLEGGGGSGGGGSGGGGSFEVQLVESGGGLVQAGGSLRLSCAASGSIFSGNVMGWYRRQAPGKEREWVAAIASGGSIYYRDSVKGRFTISRDNAKNTVYLQMNSLKPEDTAVYYCNSHPPTLPYWGLGTQVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6541 - protein, 1159 aa, Artificial Sequence
  Synthetic Polypeptide encoding a CAR with optional accessory module(s)
MALPVTALLLPLALLLHAARPDEFEVQLVESGGGLVQAGDSLRLSCAASGRAFSRYAMGWFRQAPGKEREFVAAIGWGPSKTNYADSVKGRFTISRDNAKNTVYLQMNTLKPEDTAVYSCAAKFVNTDSTWSRSEMYTYWGQGTLVTVSSLEGGGGSGGGGSGGGGSGSGGSGSGGSGSGGSGSGGSFEVQLVESGGGSVQAGGSLRLSCTTSGRALNMYVMGWFRQAPGNEREFVAATSSSGGSTSYPDSVKGRFTISRDNAKNTVYLQMNSLKPEDTAAYRCAASPYVSTPTMNILEEYRYWGLGTQVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6542 - protein, 1112 aa, Artificial Sequence
  Synthetic Polypeptide encoding a CAR with optional accessory module(s)
MALPVTALLLPLALLLHAARPDIQMTQSPSSLSASVGDRVTITCSASSSVSYMYWYQQKPGKAPKLLIYLTSNLASGVPSRFSGSGSGTDFTLTISSLQPEDFATYYCQQWRSNPFTFGQGTKLEIKRGGGGSGGGGSGGGGSQITLKESGPTLVKPTQTLTLTCTFSGFSLSTSGMGVGWIRQPPGKALEWLAHIWWDDVKRYSPSLKSRLTITKDTSKNQVVLTMTNMDPVDTATYYCARIVSFDNDVVSAMDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6543 - protein, 1107 aa, Artificial Sequence
  Synthetic Polypeptide encoding a CAR with optional accessory module(s)
MALPVTALLLPLALLLHAARPEIVMTQSPATLSVSPGERATLSCKASQSVSNDVVWYQQKPGQAPRLLIYYASNRYTGIPARFSGSGSGTEFTLTISSLQSEDFAVYYCQQDYTSPWTFGQGTKLEIKRGGGGSGGGGSGGGGSQVQLVQSGAEVKKPGASVKVSCKASGYTFTNYGMNWVRQAPGQGLEWMGWINTYTGEPTYADDFKGRVTMTTDTSTSTAYMELRSLRSDDTAVYYCARIGDSSPSDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6544 - protein, 1108 aa, Artificial Sequence
  Synthetic Polypeptide encoding a CAR with optional accessory module(s)
MALPVTALLLPLALLLHAARPDSTDIQMTQSPSSLSASVGDRVTITCRASQSISSYLNWYQQKPGKAPKLLIYLASNLQSGVPSRFSGSGSGTDFTLTISSLQPEDFATYYCQQAEYMPLTFGQGTKVEIKRAGGGGSGGGGSGGGGSEVQLLESGGGLVQPGGSLRLSCAASGFTFSGYAMSWVRQAPGKGLEWVSEIAPPGLNTRYADSVKGRFTISRDNSKNTLYLQMNSLRAEDTAVYYCAKSDTAFDYWGQGTLVTVSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6545 - protein, 1111 aa, Artificial Sequence
  Synthetic Polypeptide encoding a CAR with optional accessory module(s)
MALPVTALLLPLALLLHAARPDQAVLTQESALTTSPGETVTLTCRSSTGAVTTSNYANWVQEKPDHLFTGLIGGTNNRVPGVPARFSGSLIGDKAALTITGAQTEDEAIYFCVLWHSNHWVFGGGTKLTVLGGGGSGGGGSGGGGSDVQLVESGGGLVQPGGSRKLSCAASGFTFSSFGMHWVRQAPEKGLEWVAYISSGSSTLHYADTVKGRFTISRDNPKNTLFLQMTSLRSEDTAMYYCARWGNYPHYAMDYWGQGTSVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6546 - protein, 993 aa, Artificial Sequence
  Synthetic Polypeptide encoding a CAR with optional accessory module(s)
MALPVTALLLPLALLLHAARPDEFEVQLVESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6547 - protein, 1135 aa, Artificial Sequence
  Synthetic Polypeptide encoding a CAR with optional accessory module(s)
MALPVTALLLPLALLLHAARPDEFEVQLVESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTLVTVSSLEGGGGSGGGGSGGGGSFEEVQLVESGGGSVQAGGSLRLSCAASGDTYGSYWMGWFRQAPGKEREGVAAINRGGGYTVYADSVKGRFTISRDTAKNTVYLQMNSLRPDDTADYYCAASGVLGGLHEDWFNYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6548 - protein, 1154 aa, Artificial Sequence
  Synthetic Polypeptide encoding a CAR with optional accessory module(s)
MALPVTALLLPLALLLHAARPDEFEVQLVESGGGSVQAGGSLRLTCAASGSTSRSYGMGWFRQAPGKEREFVSGISWRGDSTGYADSVKGRFTISRDNAKNTVDLQMNSLKPEDTAIYYCAAAAGSTWYGTLYEYDYWGQGTLVTVSSLEGGGGSGGGGSGGGGSGSGGSGSGGSGSGGSGSGGSFEVQLVESGGGSVQAGGSLRLSCAASGDTYGSYWMGWFRQAPGQEREAVAAINRGGGYTVYADSVKGRFTISRDNAKNTLYLQMNSLRPDDTADYYCAASGVLGGLHEDWFNYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6549 - protein, 1102 aa, Artificial Sequence
  Synthetic Polypeptide encoding a CAR with optional accessory module(s)
MALPVTALLLPLALLLHAARPDIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVEGGGGSGGGGSGGGGSEVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6550 - protein, 1108 aa, Artificial Sequence
  Synthetic Polypeptide encoding a CAR with optional accessory module(s)
MALPVTALLLPLALLLHAARPDEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSGGGGSGGGGSGGGGSDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6551 - protein, 1115 aa, Artificial Sequence
  Synthetic Polypeptide encoding a CAR with optional accessory module(s)
MALPVTALLLPLALLLHAARPDELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6552 - protein, 1116 aa, Artificial Sequence
  Synthetic Polypeptide encoding a CAR with optional accessory module(s)
MALPVTALLLPLALLLHAARPDELQMTQSPSSLSASVGDRVTITCRASQSISSYLNWYQQKPGQPPKLLIYWASTRESGVPDRFSGSESGTNYTLTISSLQPEDFATYFCQQSDSLPITFGQGTRLDIQGGGGSGGGGSGGGGSEVQLLESGGGVVQPGRSLRLSCAASGFTFSSYGMHWVRQAPGKGLEWVAVISYDGSNKYYADSVKGRFTISRDNSKNTLYLQMNSLRAEDTAVYYCAKDMGWGSGWRPYYYYGMDVWGQGTTVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6553 - protein, 1113 aa, Artificial Sequence
  Synthetic Polypeptide encoding a CAR with optional accessory module(s)
MALPVTALLLPLALLLHAARPDDIQMTQSPSSLSASVGDRVTITCRASQSISSYLNWYQQKPGKAPKLLIYAASSLQSGVPSRFSGSGSGTDFTLTISSLQPEDLATYYCQQSYSTPFTFGPGTKVDIKGGGGSGGGGSGGGGSVHEVQLVQSGAEVKKPGSSVKVSCKASGGTFSSYAISWVRQAPGQGLEWMGGIIPIFGTANYAQKFQGRVTITADKSTSTAYMELSSLRSEDTAVYYCATFALFGFREQAFDIWGQGTTVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6554 - protein, 1110 aa, Artificial Sequence
  Synthetic Polypeptide encoding a CAR with optional accessory module(s)
MALPVTALLLPLALLLHAARPDVVMTQTPLSLPVSLGDQASISCRSSQSLVHSNGNTYLRWYLQKPGQSPKVLIYKVSNRFSGVPDRFSGSGSGTDFTLKISRVEAEDLGVYFCSQSTHVPWTFGGGTKLEIKGGGGSGGGGSGGGGSEVKLDETGGGLVQPGRPMKLSCVASGFTFSDYWMNWVRQSPEKGLEWVAQIRNKPYNYETYYSDSVKGRFTISRDDSKSSVYLQMNNLRVEDMGIYYCTGSYYGMDYWGQGTSVTVSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6555 - protein, 1121 aa, Artificial Sequence
  Synthetic Polypeptide encoding a CAR with optional accessory module(s)
MALPVTALLLPLALLLHAARPDVVMTQTPLSLPVSLGDQASISCRSSQSLVHSNGNTYLRWYLQKPGQSPKVLIYKVSNRVSGVPDRFSGSGSGTDFTLKINRVEAEDLGVYFCSQSTHVPWTFGGGTKLEIKSSADDAKKDAAKKDDAKKDDAKKDGGVKLDETGGGLVQPGGAMKLSCVTSGFTFGHYWMNWVRQSPEKGLEWVAQFRNKPYNYETYYSDSVKGRFTISRDDSKSSVYLQMNNLRVEDTGIYYCTGASYGMEYLGQGTSVTVSTTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6556 - protein, 1117 aa, Artificial Sequence
  Synthetic Polypeptide encoding a CAR with optional accessory module(s)
MALPVTALLLPLALLLHAARPQVQLVESGGNLVQPGGSLRLSCAASGFTFGSFSMSWVRQAPGGGLEWVAGLSARSSLTHYADSVKGRFTISRDNAKNSVYLQMNSLRVEDTAVYYCARRSYDSSGYWGHFYSYMDVWGQGTLVTVSGGGGSGGGGSGGGGSSVLTQPSSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLGTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6557 - protein, 1112 aa, Artificial Sequence
  Synthetic Polypeptide encoding a CAR with optional accessory module(s)
MALPVTALLLPLALLLHAARPDIQMTQSPSSLSASVGDRVTITCRTSQSLSSYTHWYQQKPGKAPKLLIYAASSRGSGVPSRFSGSGSGTDFTLTISSLQPEDFATYYCQQSRTFGQGTKVEIKGGGGSGGGGSGGGGSQVQLQQSGPGLVKPSQTLSLTCAISGDSVSSYNAVWNWIRQSPSRGLEWLGRTYYRSGWYNDYAESVKSRITINPDTSKNQFSLQLNSVTPEDTAVYYCARSGHITVFGVNVDAFDMWGQGTMVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6558 - protein, 1111 aa, Artificial Sequence
  Synthetic Polypeptide encoding a CAR with optional accessory module(s)
MALPVTALLLPLALLLHAARPDIVLTQSPLSLAVSLGQPAIISCKASQSVSFAGTSLMHWYHQKPGQQPRLLIYRASNLEAGVPDRFSGSGSKTDFTLTISPVEAEDAATYYCQQSREYPYTFGGGTKLEIKRGGGGSGGGGSGGGGSQVQLVQSGAEVVKPGASVKISCKASGYTFTGYFMNWVKQSPGQSLEWIGRIHPYDGDTFYNQKFQGKATLTVDKSSNTAHMELLSLTSEDFAVYYCTRYDGSRAMDYWGQGTTVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6559 - protein, 1084 aa, Artificial Sequence
  Synthetic Polypeptide encoding a CAR with optional accessory module(s)
MALPVTALLLPLALLLHAARPNSCELTNITIAIEKEECRFCISINTTWCAGYCYTRDLVYKDPARPKIQKTCTFKELVYETVRVPGCAHHADSLYTYPVATQCHCGKCDSDSTDCTVRGLGPSYCSFGEMKEGGGGSGGGGSGGGGSAPDVQDCPECTLQENPFFSQPGAPILQCMGCCFSRAYPTPLRSKKTMLVQKNVTSESTCCVAKSYNRVTVMGGFKVENHTACHCSTCYYHKSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6560 - protein, 1115 aa, Artificial Sequence
  Synthetic Polypeptide encoding a CAR with optional accessory module(s)
MALPVTALLLPLALLLHAARPDLETTLTQSPATLSVSPGERVTLSCRASQSVGSNLAWYQQKFGQAPRLLIYDASTRATGIPARFSGSGSGTEFTLTISRLEPEDFAVYYCHQYGSSPRTFGQGTKVDIKRGGGGSGGGGSGGGGSQVQLVQSGAEVKKPGASVKVSCKASGYTFTTYGISWVRQAPGQGLEWMGWISAYNGHTNYAQMLQGRVTMTTDTSTSTAYMELRGLRSDDTAVYYCAREAYASYGSGSYWTDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6561 - protein, 1108 aa, Artificial Sequence
  Synthetic Polypeptide encoding a CAR with optional accessory module(s)
MALPVTALLLPLALLLHAARPDDVVMTQTPLSLPVTPGEPASISCRSSQSLVHRNGNTYLHWYLQKPGQSPKLLIHKVSNRFSGVPDRFSGSGSGTDFTLKISRVEAEDLGVYFCSQSTHVPPLTFGAGTKLELKGGGGSGGGGSGGGGSEVQLVQSGAEVEKPGASVKISCKASGSSFTGYNMNWVRQNIGKSLEWIGAIDPYYGGTSYNQKFKGRATLTVDKSTSTAYMHLKSLRSEDTAVYYCVSGMEYWGQGTSVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6562 - protein, 1106 aa, Artificial Sequence
  Synthetic Polypeptide encoding a CAR with optional accessory module(s)
MALPVTALLLPLALLLHAARPDEIVMTQTPATLSVSAGERVTITCKASQSVSNDVTWYQQKPGQAPRLLIYSASNRYSGVPARFSGSGYGTEFTFTISSVQSEDFAVYFCQQDYSSFGQGTKLEIKRGGGGSGGGGSGGGGSQVQLVESGPGVVQPGRSLRISCAVSGFSVTNYGVHWVRQPPGKGLEWLGVIWAGGITNYNSAFMSRLTISKDNSKNTVYLQMNSLRAEDTAMYYCASRGGHYGYALDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6563 - protein, 1108 aa, Artificial Sequence
  Synthetic Polypeptide encoding a CAR with optional accessory module(s)
MALPVTALLLPLALLLHAARPDIQMTQTASSLPASLGDRVTISCSASQDISNYLNWYQQKPDGTVKLLIFYSSNLHSGVPSRFSGGGSGTDYSLTISNLEPEDIATYFCHQYSKLPWTFGGGTKLEIKRGGGGSGGGGSGGGGSEVTLVESGGDFVKPGGSLKVSCAASGFAFSHYAMSWVRQTPAKRLEWVAYISSGGSGTYYSDSVKGRFTISRDNAKNTLYLQMRSLRSEDSAMYFCTRVKLGTYYFDSWGQGTTLTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6564 - protein, 1110 aa, Artificial Sequence
  Synthetic Polypeptide encoding a CAR with optional accessory module(s)
MALPVTALLLPLALLLHAARPQFVLTQSPSASAALGASAKLTCTLSSAHKTYTIDWYQQQKGKAPRYLIQVKSDGTYTKATGVPDRFSGSSSGADRYLIIPSVQADDEADYYCGTDYTGGYVFGGGTQLTVTGGGGSGGGGSGGGGSEQLKESGGGLFKPTDTLTLTCTVSGFSLSYYGVNWVRQAPGNGLEWIGTIGGSGDTYYASWAKSRSTIIRNTNENTVTLKMTSLTAADTATYFCVRYANIGYEYFNVWGPGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6565 - protein, 1115 aa, Artificial Sequence
  Synthetic Polypeptide encoding a CAR with optional accessory module(s)
MALPVTALLLPLALLLHAARPQFVLTQSPSVSAALGASAKLTCTLSSAHKTYTIDWYQQQQGEAPRYLMQVKSDGSYTKGTGVPDRFSGSSSGADRYLIIPSVQADDEAGYVCGADDNGGYVFGGGTQLTVTGGGGSGGGGSGGGGSQSVKESEGGLFKPTDTLTLTCTVSGFSLSRHALTWVRQAPGNGLEWIGAIDNAGTTYYASWAKSRSTITRNTDLHTVTLKMTSLTASDTATYFCARVFYDINSGYYLDGMDLWGPGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6566 - protein, 1109 aa, Artificial Sequence
  Synthetic Polypeptide encoding a CAR with optional accessory module(s)
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKGGGGSGGGGSGGGGSEVQLVESGGGLVQPGESLRLSCVASGFTFSRYKMNWVRQAPGKGLEWVSYISRSGRDIYYADSVKGRFTISRDNAKNSLYLQMNSLRDEDTAVYYCAGTVTTYYYFGMDVWGHGTTVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6567 - protein, 1110 aa, Artificial Sequence
  Synthetic Polypeptide encoding a CAR with optional accessory module(s)
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKGGGGSGGGGSGGGGSEVQLVESGGGSVQPGESLRLSCVASGFTFSRYKMNWVRQAPGKGLEWVSYISRSGRDIYYADSVKGRFTISRDNAKNSLYLQMNSLRDEDTAVYYCAGTVTTYYYDFGMDVWGQGTTVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6568 - protein, 1109 aa, Artificial Sequence
  Synthetic Polypeptide encoding a CAR with optional accessory module(s)
MALPVTALLLPLALLLHAARPQSVLTQPPSASGTPGQRVTISCSGSRSNVGGNYVFWYQQVPGATPKLLIYRSNQRPSGVPDRFAGSKSGSSASLAISGLRSEDEADYYCATWDDSLSGFVFGTGTKVTVLGGGGGSGGGGSGGGGSEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARGYGKAYDQWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6569 - protein, 1108 aa, Artificial Sequence
  Synthetic Polypeptide encoding a CAR with optional accessory module(s)
MALPVTALLLPLALLLHAARPQSVVTQPPSMSAAPGQQVTISCSGGNSNIERNYVSWYLQLPGTAPKLVIFDNDRRPSGIPDRFSGSKSGTSATLGITGLQTGDEADYYCGTWDSSLRGWVFGGGTKLTVLGGGGGSGGGGSGGGGSEVQLVESGGGLIQPGGSLRLSCAASGFTFSNYAMNWVRQAPGKGLEWVSTINGRGSSTIYADSVKGRFTISRDNSKNTLYLQMNSLRAEDTATYYCARYISRGLGDSWGQGTLVTVTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6570 - protein, 1108 aa, Artificial Sequence
  Synthetic Polypeptide encoding a CAR with optional accessory module(s)
MALPVTALLLPLALLLHAARPQSVVTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSYVFGTGTKLTVLGGGGGSGGGGSGGGGSEVQLVETGGNLVQPGASLRLSCAASGFSFSGTAMHWVRQAPGKGLEWVSTISSTGRSTYYRDSVKGRFTISRDNSKNTLYLQMNSLRGEDTAVYYCARVSFDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6571 - protein, 1110 aa, Artificial Sequence
  Synthetic Polypeptide encoding a CAR with optional accessory module(s)
MALPVTALLLPLALLLHAARPQSVVTQPASVSGSPGQSITISCTGTSSDVGGYNYVSWYQQHPGKAPKLMIYDVSKRPSGVSNRFSGSKSGNTASLTISGLQAEDEADYYCSSYTSSSTLVFGGGTKLTVLGGGGGSGGGGSGGGGSEVQLVESGGAFVQPGGSLRLSCAASGFTFSSYAMTWVRQAPGKGLEWVSTISGRGRSTFYADSVKGRFTISRDNSKNTLYLQMNSLRAEDTAVYYCARYYHAGAFDLWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6572 - protein, 1108 aa, Artificial Sequence
  Synthetic Polypeptide encoding a CAR with optional accessory module(s)
MALPVTALLLPLALLLHAARPDNIELTQSPAIMSASPGERVTMTCSASSSIRYIYWYQQKPGSSPRLLIYDTSNVAPGVPFRFSGSGSGTSYSLTINRMEAEDAATYYCQEWSGYPYTFGGGTKLDIKRGGGGSGGGGSGGGGSQVKLQESGGGLVKPGGSLKLSCAASGFTFSSYGMSWVRQTPDKRLEWVATISSGGSYTYYPDSVKGRFTISRDNAKNTLYLQMSSLKSEDTAMYYCARGNWEGWYFDVWGQGTTVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6573 - protein, 1118 aa, Artificial Sequence
  Synthetic Polypeptide encoding a CAR with optional accessory module(s)
MALPVTALLLPLALLLHAARPDNFMLTQPHSVSESPGKTVTISCTGSGGSIDNNYVHWYQQRPGSAPTTVMFEDNQRPSGVPDRFSGSIDSSSNSASLVISGLKTEDEGDYYCQSSDGSKVVFGGGTKLTVLGQGGGGSGGGGSGGGGSEVQLVQSGGGSLTLSCAASGVVQPGRFTFSSYGMHWVRQAPGKGLEWVSVISYDGSNKYYADSVKGRFTISRDNSKNTLYLQMNSLRTEDTAVYYCAKTLSAGEWIGGGAFDIWGHGTMVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6574 - protein, 1108 aa, Artificial Sequence
  Synthetic Polypeptide encoding a CAR with optional accessory module(s)
MALPVTALLLPLALLLHAARPDVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQNTPVPPKFGSGTKLEIKGGGGSGGGGSGGGGSQVQLQQSGAELVRPGASVKLSCKASGYTFNDYEMHWVKQTPVHGLKWIGALEPKTGDTAYSQKFKGKATLTADKSSSTAYMELRSLTSEDSAVYYCTSCYYYTYSGQGTLVTVSATRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6575 - protein, 1107 aa, Artificial Sequence
  Synthetic Polypeptide encoding a CAR with optional accessory module(s)
MALPVTALLLPLALLLHAARPDIQLTQSPSSLSASVGDRVTITCRASQGIRNDLGWYQQKPGKAPKRLIYAASSLQNGVPSRFSGSGSGTEFTLTISSLQPEDFATYYCLQHNTYPAFGQGTKVEIKRGGGGSGGGGSGGGGSQVQLQESGPGLVKPSQTLSLTCTVSGGSISSFNYYWSWIRHHPGKGLEWIGYIYYSGSTYSNPSLKSRVTISVDTSKNQFSLTLSSVTAADTAVYYCARGYNWNYFDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6576 - protein, 1109 aa, Artificial Sequence
  Synthetic Polypeptide encoding a CAR with optional accessory module(s)
MALPVTALLLPLALLLHAARPDDIVLTQSPASLAVSLGQSVTISCRASESVEYYGTSLMQWYQQKPGQPPKLLIYATSNVESGVPARFSGSGSGTDFSLNIHPVEEDDIAMYFCQQSRKLPSTFGGGTKLEIKGGGGSGGGGSGGGGSDVRLQESGPGQVKPSQTVSLTCSVTGYSITNGNHWWNWIRQVSGSKLEWIGYISSSGSTDSNPSLKSRISITRDTSKNQLFLQLNSVTTEDIATYYCARGYYFDYWGQGTTLTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6577 - protein, 987 aa, Artificial Sequence
  Synthetic Polypeptide encoding a CAR with optional accessory module(s)
MALPVTALLLPLALLLHAARPDEFEVQLVESGGGLVQAGGSLRLSCAASGITFSINTMGWYRQAPGKQRELVALISSIGDTYYADSVKGRFTISRDNAKNTVYLQMNSLKPEDTAVYYCKRFRTAAQGTDYWGQGTQVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6578 - protein, 922 aa, Artificial Sequence
  Synthetic Polypeptide encoding a CAR with optional accessory module(s)
MDWIWRILFLVGAATGAHSFEGSGFEYAKEMRNAYWEIALLPNLTNQQKRAPIRKLYDDPSQSSELLSEAKKLNDSQTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6579 - protein, 993 aa, Artificial Sequence
  Synthetic Polypeptide encoding a CAR with optional accessory module(s)
MALPVTALLLPLALLLHAARPDEFGSDLGIKLLFAAAKGQDDEVRILLAAGADVNAKDFEGYTPLHVAAYDGHLEIVEVLLKAGADVNAKDSQGRTPLHEAAYSGHLEIVEVLLKAGADVNAQDDAGETPADLAAAWGHEDIAEVLQKTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6580 - protein, 992 aa, Artificial Sequence
  Synthetic Polypeptide encoding a CAR with optional accessory module(s)
MDWIWRILFLVGAATGAHSFERSDLGKKLLEAARAGQDDEVRILMANGADVNAKDEYGLTPLYLATAHGHLEIVEVLLKNGADVNAVDAIGFTPLHLAAFIGHLEIAEVLLKHGADVNAQDKFGKTAFDISIGNGNEDLAEILQKLNTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6581 - protein, 1144 aa, Artificial Sequence
  Synthetic Polypeptide encoding a CAR with optional accessory module(s)
MALPVTALLLPLALLLHAARPDEFEVQLVESGGGLVQAGGSLRLSCAASGITFSINTMGWYRQAPGKQRELVALISSIGDTYYADSVKGRFTISRDNAKNTVYLQMNSLKPEDTAVYYCKRFRTAAQGTDYWGQGTQVTVSSLEGGGGSGGGGSGGGGSGSGGSGSGGSGSGGSGSGGSFEVQLVESGGGLVQPGGSLRLSCAASGSIFGFNDMAWYRQAPGKQRELVALISRVGVTSSADSVKGRFTISRVNAKDTVYLQMNSLKPEDTAVYYCYMDQRLDGSTLAYWGQGTQVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6582 - protein, 1108 aa, Artificial Sequence
  Synthetic Polypeptide encoding a CAR with optional accessory module(s)
MALPVTALLLPLALLLHAARPDIQMTQSPSSLSASVGDRVTITCRASQDVNTAVAWYQQKPGKAPKLLIYSASFLESGVPSRFSGSRSGTDFTLTISSLQPEDFATYYCQQHYTTPPTFGQTKVEIKRGGGGSGGGGSGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDVWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6583 - protein, 987 aa, Artificial Sequence
  Synthetic Polypeptide encoding a CAR with optional accessory module(s)
MALPVTALLLPLALLLHAARPDEFDVQLVESGGGLVQPGGSLRLSCAASGSIGGLNAMAWYRQAPGKERELVAGIFGVGSTRYADSVKGRFTISRDNSKNTVYLQMNSLRPEDTAVYYCRMSSVTRGSSDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6584 - protein, 927 aa, Artificial Sequence
  Synthetic Polypeptide encoding a CAR with optional accessory module(s)
MALPVTALLLPLALLLHAARPDEFVDNKFNKERYSAYYEIWQLPNLNVRQKAAFIGSLQDDPSQSANLLAEAKKLNDAQAPKTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6585 - protein, 1149 aa, Artificial Sequence
  Synthetic Polypeptide encoding a CAR with optional accessory module(s)
MALPVTALLLPLALLLHAARPDEFDVQLVESGGGLVQPGGSLRLSCAASGSIGGLNAMAWYRQAPGKERELVAGIFGVGSTRYADSVKGRFTISRDNSKNTVYLQMNSLRPEDTAVYYCRMSSVTRGSSDYWGQGTLVTVSSLEGGGGSGGGGSGGGGSGSGGSGSGGSGSGGSGSGGSFEVQLVESGGSLVQPGGSLRLSCAASGFTFDDYAMSWVRQVPGKGLEWVSSINWSGTHTDYADSVKGRFTISRNNANNTLYLQMNSLKSEDTAVYYCAKNWRDAGTTWFEKSGSAGQGTQVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6586 - protein, 1107 aa, Artificial Sequence
  Synthetic Polypeptide encoding a CAR with optional accessory module(s)
MALPVTALLLPLALLLHAARPDQSVLTQPPSVSVAPGKTARIPCEGNYIGSSNVHWYQQKPGQAPVLVIHFDSDRPSGIPDRFSGSNSGNMATLTISRVEAGDEADYYCQVWENHGWVFGGGTKLTVLSGGGGSGGGGSGGGGSEVQLVETGGGLVQPGESLRLSCAASGFTFSDYEMNWVRQAPGKGLEWVSYISSSGSTIYYADSVKGRFTIYRDNAKNSLYLQMNSLRAEDTALYYCARAWGVGPPDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6587 - protein, 1115 aa, Artificial Sequence
  Synthetic Polypeptide encoding a CAR with optional accessory module(s)
MALPVTALLLPLALLLHAARPDIQMTQSPSSLSASVGDTVTITCQANGYLNWYQQRRGKAPKLLIYDGSKLERGVPSRFSGRRWGQEYNLTINNLQPEDIATYFCQVYEFVVPGTRLDLKRTVAAPGGGGSGGGGSGGGGSQVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVSSASTKGPTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6588 - protein, 1121 aa, Artificial Sequence
  Synthetic Polypeptide encoding a CAR with optional accessory module(s)
MALPVTALLLPLALLLHAARPQSALTQPPSASGSPGQSITISCTGTSNNFVSWYQQHAGKAPKLVIYDVNKRPSGVPDRFSGSKSGNTASLTVSGLQTDDEAVYYCGSLVGNWDVIFGGGTKLTVLGGGGSGGGGSGGGGSQPQLQESGPTLVEASETLSLTCAVSGDSTAACNSFWGWVRQPPGKGLEWVGSLSHCASYWNRGWTYHNPSLKSRLTLALDTPKNLVFLKLNSVTAADTATYYCARFGGEVLRYTDWPKPAWVDLWGRGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6589 - protein, 1106 aa, Artificial Sequence
  Synthetic Polypeptide encoding a CAR with optional accessory module(s)
MALPVTALLLPLALLLHAARPEIVLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIKRGGGGSGGGGSGGGGSQVQLVQSGGQMKKPGESMRISCRASGYEFIDCTLNWIRLAPGKRPEWMGWLKPRGGAVNYARPLQGRVTMTRDVYSDTAFLELRSLTVDDTAVYFCTRGKNCDYNWDFEHWGRGTPVIVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6590 - protein, 1116 aa, Artificial Sequence
  Synthetic Polypeptide encoding a CAR with optional accessory module(s)
MALPVTALLLPLALLLHAARPELVLTQSPGTLSLSAGERATLSCRASQSVSSGSLAWYQQKPGQAPRLLIYGASTRATGIPDRFSGSGSGTDFTLTIGRLEPEDLAVYYCQQYGTSPYTFGQGTKLEIGGGGSGGGGSGGGGSLEQSGAEVKKPGSSVQVSCKASGGTFSMYGFNWVRQAPGHGLEWMGGIIPIFGTSNYAQKFRGRVTFTADQATSTAYMELTNLRSDDTAVYYCARDFGPDWEDGDSYDGSGRGFFDFWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6591 - protein, 1112 aa, Artificial Sequence
  Synthetic Polypeptide encoding a CAR with optional accessory module(s)
MALPVTALLLPLALLLHAARPDVVMTQSPSSLSASVGDRVTITCQSSLDISHYLNWYQQKPGKAPKLLIYDASNLETGVPSRFSGSGSGTHFTFTISSLQPEDFATYYCQQYDNLPLTFGGGTKLEIKRGGGGSGGGGSGGGGSQVQLVQSGGGVVQPGGSLRVSCAASGVTLSDYGMHWVRQAPGKGLEWVAFIRNDGSDKYYADSVKGRFTISRDNSEKTVSLQMSSLRAEDTAVYYCAKNGESGPLDYWYLDLWGRGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6592 - protein, 1112 aa, Artificial Sequence
  Synthetic Polypeptide encoding a CAR with optional accessory module(s)
MALPVTALLLPLALLLHAARPDDIVMTQSQDSMATSVGERVTVNCKASQNVDTNVAWYQQKPGQSPEPLLFSASYRYTGVPDRFSGSGSGTDFTLTISSVQAEDVAEYFCQQYNSYPLTFGQGTKLEIKRGGGGSGGGGSGGGGSEVQVEVSGGGLVQPGGSMRLSCAVSGFTFSNYWMNWVRQSPEKGLEWIAEIRLKSNNFARYYAESVKGRFTISRDNSKNSLYLQMISLRAEDTAIYYCTSYGNYVGHYFDHWGQGTLLTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6593 - protein, 1116 aa, Artificial Sequence
  Synthetic Polypeptide encoding a CAR with optional accessory module(s)
MALPVTALLLPLALLLHAARPSYELTQPPSVSGTPGQRVAISCSGSSSNIGTRMVTWYQHVPGTAPKLLIFNNNQRPSGVPDRFSASKSGTSASLAIIGLQSDDEADYYCATWDDNVKSYVFGTGTKVTVLGSRGGGGSGGGGSGGGGSLEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARAPQSWYVGDVWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6594 - protein, 1113 aa, Artificial Sequence
  Synthetic Polypeptide encoding a CAR with optional accessory module(s)
MALPVTALLLPLALLLHAARPQSVLTQPPSLSVAPGKTASITCGGNNIGMKSVHWYQQRPGQAPVLVIYYDSDRPSGIPGRFSGSNSGNTATLTISRVEAGDEADYYCQVWDTTGDHPGYVFGTGTKVTVLGGGGSGGGGSGGGGSQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGVYGYSGSAPYDEWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6595 - protein, 1119 aa, Artificial Sequence
  Synthetic Polypeptide encoding a CAR with optional accessory module(s)
MALPVTALLLPLALLLHAARPDEIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPRTFGQGTKVEIKRGGGGSGGGGSGGGGSQVQLVQSGGGVVQPGRSLRLSCAASGFTFSSYGMHWVRQAPGKGLEWVAVISYDGSNKYYADSVKGRFTISRDNSKNTLYLQMNSLRAEDTAVYYCARDFDYGDSYYYYGMDVWGQGTTVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6596 - protein, 1113 aa, Artificial Sequence
  Synthetic Polypeptide encoding a CAR with optional accessory module(s)
MALPVTALLLPLALLLHAARPDEIVLTQSPATLSLSPGERATLSCRASQSVGSYLAWYQQKPGAPRLLIYDASHRATGIPARFSGSGSGTDFTLTISSLEPEDFAVYYCQQRSNWPPMYTFGQGTKLEIKRGGGGSGGGGSGGGGSEVQLVQSGAEVSVKVSCKASGGKKPGSTFSSYTISWVRQAPGQGLEWMGGIIPIFGTANYAQKFQGRVTITADKSTSTAYMELSSLRSEDTAVYYCAGDTDSSGYYGAVDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6597 - protein, 1096 aa, Artificial Sequence
  Synthetic Polypeptide encoding a CAR with optional accessory module(s)
MALPVTALLLPLALLLHAARPDIQMTQSPSSLSASVGDRVTITCQASQDINNYLNWYQQKPGKAPKLLIYDASNLQTGVPSRFSGSGSGTDFTFTIEDIATYYCQQYTFGPGTKVDIKGGGGSGGGGSGGGGSEVQLLESGGGLVQPGGSLRLSCAASGFTFSWYSMTWVRQAPGKGLEWVSSIVPWGDFTQYADSVKGRFTISRDNSKNTLYLQMNSLRAEDTAVYYCAKGPGWGSFDLWGRGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6598 - protein, 985 aa, Artificial Sequence
  Synthetic Polypeptide encoding a CAR with optional accessory module(s)
MDWIWRILFLVGAATGAHSEVQLVESGGGLVQPGGSLRLSCAASGSVFKINVMAWYRQAPGKGRELVAGIISGGSTSYADSVKGRFTISRDNAKNTLYLQMNSLRPEDTAVYYCAFITTESDYDLGRRYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6599 - protein, 1106 aa, Artificial Sequence
  Synthetic Polypeptide encoding a CAR with optional accessory module(s)
MALPVTALLLPLALLLHAARPDIQMTQSPSSLSASVGDRVTITCTASLSVSSTYLHWYQQKPGSSPKLWIYSTSNLASGVPSRFSGSGSGTSYTLTISSLQPEDFATYYCHQYHRSPLTFGGGTKVEIKRGGGGSGGGGSGGGGSEVQLVESGGGLVQPGGSLRLSCAASGFSLTKYGVHWVRQAPGKGLEWVGVKWAGGSTDYNSALMSRFTISKDNAKNSLYLQMNSLRAEDTAVYYCARDHRDAMDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6600 - protein, 1110 aa, Artificial Sequence
  Synthetic Polypeptide encoding a CAR with optional accessory module(s)
MALPVTALLLPLALLLHAARPDIQMTQSPSSLSASVGDRVTITCKASQDVGTAVAWYQQKPGKAPKLLIYSASYRSTGVPSRFSGSGSGTDFTLTISSLQPEDFATYYCQHHYSAPWTFGGGTKVEIKGGGGSGGGGSGGGGSEVQLVESGGGLVQPGGSLRLSCAASGFTFSRNGMSWVRQAPGKGLEWVATVSSGGSYIYYADSVKGRFTISRDNAKNSLYLQMNSLRAEDTAVYYCARQGTTALATRFFDVWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6601 - protein, 1116 aa, Artificial Sequence
  Synthetic Polypeptide encoding a CAR with optional accessory module(s)
MALPVTALLLPLALLLHAARPDIVMTQSPSSLTMSVGQKVTMSCKSSHSLLNSRNQKNYLAWFQQKPGQSPKLLVYFASTRESGVPDRFIGSGSGTDFTLTISNVQAEDLADYFCQQHYTTLPTFGGGTKLEIKGGGGSGGGGSGGGGSQIQLVQSGPDLKKPGETVKISCKASGYTFTNTGMNWVKQAPGKGLKWMGWINTYTGEPTYADDFKGRFTFSLETSASTAYLQINNLKNEDTATYFCTRWGYGSSLYYAMDYWGQGTSVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6602 - protein, 1106 aa, Artificial Sequence
  Synthetic Polypeptide encoding a CAR with optional accessory module(s)
MALPVTALLLPLALLLHAARPDIQMTQSPPSLSASVGGKVTITCKASQDIDRYMAWYQDKPGKGPKLLIHDTSTLQPGIPSRFSGSGSGRDYSFSISNLEPEDIATYYCLQYDNLWTFGGGTKLEIKRGGGGSGGGGSGGGGSQVQLVQSGAELVKPGASVKMSCKASGYIFTNYNIHWVKKSPGQGLEWIGAIYPGNGDAPYSQKFQDRATLTADTSSSTTYMELSSLTSEDSAVYYCVRANWDVAFAYWGQGTLVSVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6603 - protein, 1107 aa, Artificial Sequence
  Synthetic Polypeptide encoding a CAR with optional accessory module(s)
MALPVTALLLPLALLLHAARPDIQMTQSPASLSASVGETVTITCRVSGNIHNYLAWYQQKQGKSPQLLVYNAKTLADGVPSRFSGSGSGTQYSLKINSLQPEDFGSYYCQHFWSNPYTFGGGTKLEIKGGGGSGGGGSGGGGSQVQLQQSGASVKVSCKASELVRPGTGYAFTNYLIEWVKQRPGQGLEWIGVINPGSGGTNYNEKFKGKATLTADKSSSTAYMQLSSLTSDDSAVYFCARYRSYDWYFDVWGAGTTVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6604 - protein, 1112 aa, Artificial Sequence
  Synthetic Polypeptide encoding a CAR with optional accessory module(s)
MALPVTALLLPLALLLHAARPDDIQMTQSPSSLSASVGDRVTITCRSSQRIVHSNGNTYLEWYQQTPGKAPKLLIYKVSNRFSGVPSRFSGSGSGTDYTPTISSLQPEDIATYYCFQGSHVPPTFGQGTKLQITGGGGSGGGGSGGGGSEVQLVESGGGVVQPGRSLRLSCSSSGPTFSDYYMYWVRQAPGKGLEWVAYMSNVGAITDYPDTVKGRPTISRDNSKNTLFLMDSLRPEDTGVYFCARGTRDGSWFAYWGQGTPVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6605 - protein, 1106 aa, Artificial Sequence
  Synthetic Polypeptide encoding a CAR with optional accessory module(s)
MALPVTALLLPLALLLHAARPDIQMTQSFSSLSASVGDRVTITCRASQDISNYLNWYQQKPGKAPKLLIYYTSRLHSGVPSRFSGSGSGTDYTLTISSLQPEDFATYFCQQGNTLPWTFGGGTKLEIKRGGGGSGGGGSGGGGSEVQLVQSGGGLVQSGGSLRLSCRASGYTFTRYWMLWVRQRPGKGLEWVAEINPRNDRTNYNEKFKTRFTISVDRSKNTLYLQMDSLRAEDTAVYFCALGGGYAMDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6606 - protein, 1093 aa, Artificial Sequence
  Synthetic Polypeptide encoding a CAR with optional accessory module(s)
MEMLQGLLLLLLLSMGGAWASREPLRPWCHPINAILAVEKEGCPVCITVNTTICAGYCPTMMRVLQAVLPPLPQVVCTYRDVRFESIRLPGCPRGVDPVVSFPVALSCRCGPCRRSTSDCGGPKDHPLTCDHPQLSGLLFLGGGGSGGGGSGGGGSAPDVQDCPECTLQENPFFSQPGAPILQCMGCCFSRAYPTPLRSKKTMLVQKNVTSESTCCVAKSYNRVTVMGGFKVENHTACHCSTCYYHKSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6607 - protein, 1107 aa, Artificial Sequence
  Synthetic Polypeptide encoding a CAR with optional accessory module(s)
MALPVTALLLPLALLLHAARPDIQMTQSPASLSASVGETVTIICRASVNIYSYLAWYQQKQGKSPQLLVYNAKILAEGVPSRFSGSGSGTQFSLKINSLQPEDFGSYYCQHHYGTFTFGSGTKLEIKRGGGGSGGGGSGGGGSQVQLKESGPGLVAPSQSLSITCTISGFSLTSYGVHWVRQPPGKGLEWLVVIWSDGSTTYNSALKSRLSISKDNSKSQVFLKMNSLQTDDTAIYYCASHYGSTLAFASWGHGTLVTVSAATRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6608 - protein, 1115 aa, Artificial Sequence
  Synthetic Polypeptide encoding a CAR with optional accessory module(s)
MALPVTALLLPLALLLHAARPDIVMTQSHKFMSTSVGDRVSVTCKASQNVGNNVAWYQQKPGQSPKVLIYSASYRYSGVPDRFTGSGSGTDFTLTISNVQSEDLAEYFCQQYNTYPFTFGSGTKLEIKGGGGSGGGGSGGGGSEVQLEESGGGLVQPGGSMKLSCVASGFTFSNYWMNWVRQSPEKGLEWVAEIRFKSHNYATHFAESVKGRFTISRDDSKSSVYLQMNNLRAEDTGIYYCTRRIGNSDYDWWYFDVWGAGTSVTVSSASTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6609 - protein, 1111 aa, Artificial Sequence; identical to SEQ ID NO: 6494
  Synthetic Polypeptide encoding a CAR with optional accessory module(s)

SEQ ID NO: 6610 - protein, 1117 aa, Artificial Sequence
  Synthetic Polypeptide encoding a CAR with optional accessory module(s)
MALPVTALLLPLALLLHAARPDQSVLTQPPSVSGAPGQRVTISCTGSSSNIGAGYDVHWYQQLPGTAPKLLIYGNSNRPSGVPDRFSGSKSGTSASLAITGLQAEDEADYYCQSYDNSLSSWVFGGGTKLTVLGQPKGGGGSGGGGSGGGGSEVQLQQSGAEVKKPGSSVKVSCKASGGTFSSYAISWVRQAPGQGLEWMGRIIPILGIANYAQKFQGRVTITADKSTSTAYMELSSLRSEDTAVYYCARDVGSGSYSLDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6611 - protein, 1114 aa, Artificial Sequence
  Synthetic Polypeptide encoding a CAR with optional accessory module(s)
MALPVTALLLPLALLLHAARPDQSVVTQPPSVSAAPGRKVTISCSGSSSNIGSNYVSWYQQVPGTAPKLLIYEDDKRPSGIPDRFSGSKSGTSATLGITGLQTGDEADYFCATWDRTVNVVRFGGGTRLTVHSQPKGGGGSGGGGSGGGGSQLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARHVGHELDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6612 - protein, 1108 aa, Artificial Sequence
  Synthetic Polypeptide encoding a CAR with optional accessory module(s)
MALPVTALLLPLALLLHAARPDIQMTQSPSSLSASVGDRVTITCRASQSISSYLNWYQQKPGKAPKLLIYAASSLQSGVPSGFSGSGSGTDFTLTISSLQPEDFATYYCQQSYSTPLTFGGGTKVEIKRGGGGSGGGGSGGGGSQVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCAREGKNGAFDIWGQGTMVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6613 - protein, 994 aa, Artificial Sequence
  Synthetic Polypeptide encoding a CAR with optional accessory module(s)
MALPVTALLLPLALLLHAARPDEFDVQLVESGGGLVQPGGSLRLSCAASGFILDYYAIGWFRQAPGKEREGVLCIDASDDITYYADSVKGRFTISRDNSKNTVYLQMNSLRPEDTAVYYCATPIGLSSSCLLEYDYDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6614 - protein, 1157 aa, Artificial Sequence
  Synthetic Polypeptide encoding a CAR with optional accessory module(s)
MALPVTALLLPLALLLHAARPDEFDVQLVESGGGLVQPGGSLRLSCAASGFILDYYAIGWFRQAPGKEREGVLCIDASDDITYYADSVKGRFTISRDNSKNTVYLQMNSLRPEDTAVYYCATPIGLSSSCLLEYDYDYWGQGTLVTVSSLEGGSGSGGGGSGGGGSGSGGSGSGGSGSGGSGSGGSFEVQLVESGGGLVQPGGSLRLSCAASGRTYYLNAMGWFRQAPGKEREFVAAIDWSEGNKDYADSVKGRFTISRDNSKNTVYLQMNSLRPEDTAVYYCAADTPPWGPLIYIESYDSWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6615 - protein, 1108 aa, Artificial Sequence
  Synthetic Polypeptide encoding a CAR with optional accessory module(s)
MALPVTALLLPLALLLHAARPDQIVLTQSPAIMSASPGEKVTISCSASSSVSYMYWYQQKPGSSPKPWIYRTSNLASGVPARFSGSGSGTSYSLTISNMEAEDAAAYYCQQYHSYPTTFGGGTKLEVKGGGGSGGGGSGGGGSEVQLVESGGGLVQPKGSLKLSCAASGFSFNTYAMNWVRQAPGKGLEWIAHIRSKSNNFATYYADSVKDRFSISRDASENILFLQMNNLKTEDTAMYYCVRQGGDFPMDYWGQGTSVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6616 - protein, 1107 aa, Artificial Sequence
  Synthetic Polypeptide encoding a CAR with optional accessory module(s)
MALPVTALLLPLALLLHAARPDDIQMTQSSSSFSVSLGDRVTITCMASEDIYIRLAWYQQKPGNAPRLLISAATSLETGVPSRFSGSGSGKDYTLSITSLQTEDVGTYYCQQYWSSPWTFGGGTKLEINGGGGSGGGGSGGGGSDVQLQESGPGLVKPSQSLSLTCTVTGYSITSDYTWNWIRQFPGNKLEWMGYITYSGSTSYNPSLKSRNSITRDTSKNQFFLQLNSVTTEDTATYYCARLGRRYTMDYWGQGTSVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6617 - protein, 1106 aa, Artificial Sequence
  Synthetic Polypeptide encoding a CAR with optional accessory module(s)
MALPVTALLLPLALLLHAARPDVQLQESGPGLVKPSQSLSLTCTVTGYSITSDYTWNWIRQFPGNKLEWMGYITYSGSTSYNPSLKSRNSITRDTSKNQFFLQLNSVTTEDTATYYCARLGRRYTMDYWGQGTSVTVSSGGGGSGGGGSGGGGSDIQMTQSSSSFSVSLGDRVTITCMASEDIYIRLAWYQQKPGNAPRLLISAATSLETGVPSRFSGSGSGKDYTLSITSLQTEDVGTYYCQQYWSSPWTFGGGTKLEINTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6618 - protein, 1107 aa, Artificial Sequence
  Synthetic Polypeptide encoding a CAR with optional accessory module(s)
MALPVTALLLPLALLLHAARPDIQMTQSSSSFSVSLGDRVTITCKASEDIYIRLAWYQQKPGNAPRLLISAATSLETGIPSRFSGSGSGEDYTLTITSLQTEDVATYYCQQYWTTPWTFGGGTKLEIKRGGGGSGGGGSGGGGSDVQLQESGPGLVKPSQSLSLTCTVTGYSITIDYTWNWIRQFPGNKLEWMGYITYSGSTDYNPSLKSRSSITRDTSMNQFFLQLNSVTTEDTATYYCARLGRRYALDYWGQGTSVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6619 - protein, 1108 aa, Artificial Sequence
  Synthetic Polypeptide encoding a CAR with optional accessory module(s)
MALPVTALLLPLALLLHAARPDIVMTQAAPSIPVTPGESVSISCRSDKSLLHSNGNTYLFWFLQRPGQSPQLLIYRMSNLASGVPDRFSGSGSGTAFTLRISGVEAEDVGVYYCMQHLEYPYTFGGGTKLEIKGGGGSGGGGSGGGGSQVQLQQSGPELVKPGASVKMSCKASGYAFSSSWLNWVRQRPGKGLEWIGRIYPGDGENHYNGKFKGKATLTADKSSSTGYMQLSSLTSEDSAVYFCASYYEGGYWGQGTLITVSATRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6620 - protein, 1107 aa, Artificial Sequence
  Synthetic Polypeptide encoding a CAR with optional accessory module(s)
MALPVTALLLPLALLLHAARPDIVLTQSPASLAVSLGQSVTISCRASESVEYYGTSLMQWYQQKPGQPPKLLIYGASNVESGVPARFSGSGSGTDFSLNIHPVEEDDIAMYFCQQSRKVPWTFGGGTKLEIKGGGGSGGGGSGGGGSEVKLVESGGGLVKPGGSRKLSCAASGFTFSSYTMSWVRQTPAKRLEWVATISSGSSTIYYADTVKGRFTISRDNAKNTLFLQMTSLRSEDTAMYYCARRWFLDCWGQGTTLTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6621 - protein, 1110 aa, Artificial Sequence
  Synthetic Polypeptide encoding a CAR with optional accessory module(s)
MALPVTALLLPLALLLHAARPDQVQLQQSGPGLVKPSETLSLTCTVSGDSISSYYWSWIRQPPGKGLEWIGYIYYSGSTNYNPSLKSRVTISVDTSKSQFSLKLSSVTAADTAVYYCARGRYFDVWGRGTMVTSSGGGGSGGGGSGGGGSSSYVLTQPPSVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLGAAATRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6622 - protein, 1111 aa, Artificial Sequence
  Synthetic Polypeptide encoding a CAR with optional accessory module(s)
MALPVTALLLPLALLLHAARPDIVMTQSPLSLPVTPGEPASISCRSSKSLLHSNGNTYLYWFQQKPGQAPRLLIYRMSNLASGVPDRFSGSGSGTAFTLKISRVEAEDVGVYYCMQHIEYPFTFGQGTKLEIKGGGGSGGGGSGGGGSQVQLVQSGPEVKKPGASVKVSCKASGYTFTNSWMNWVRQRPGKGLEWIGRIYPGDGETIYNGKFRVRVTITADESTSTAYMELSSLRSEDTAVYYCARGYDDYSFAYWGQGTTVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6623 - protein, 1111 aa, Artificial Sequence
  Synthetic Polypeptide encoding a CAR with optional accessory module(s)
MALPVTALLLPLALLLHAARPDEIVMTQSPATLSLSPGERATLSCRASQSVSSYLAWYQQKPGQAPRLLIYDASNRATGIPARFSGSGSGTDFTLTISSLEPEDFAVYYCHQYGSSPQTFGQGTKVEIKRGGGGSGGGGSGGGGSEVQLVQSGAEVKKPGSSVKVSCKASGGTFSSYAISWVRQAPGQGLEWMGGIIPIFGTANYAQKFQGRVTITADESTSTAYMELSSLRSEDTAVYYCAVHYGDYVFSSMDVWGQGTTVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6624 - protein, 1114 aa, Artificial Sequence
  Synthetic Polypeptide encoding a CAR with optional accessory module(s)
MALPVTALLLPLALLLHAARPDETTLTQSPGTLSLSPGERATLSCRASQSVSSSYLAWYQQKPGQAPRLLIYGASSRATGIPDRFSGSGSGTDFTLTISRLEPEDFAVYYCQQYGSSPRTFGQGTKVEIKRGGGGSGGGGSGGGGSEVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGPEYCINGVCSLDVWGQGTTVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6625 - protein, 1116 aa, Artificial Sequence
  Synthetic Polypeptide encoding a CAR with optional accessory module(s)
MALPVTALLLPLALLLHAARPDIELTQSPSSLAVSAGEKVTMSCKSSQSLLNSRTRKNQLAWYQQKPGQSPELLIYWASTRQSGVPDRFTGSGSGTDFTLTISSVQAEDLAVYYCQQSYNLLTFGPGTKLEVKRGGGGSGGGGSGGGGSVKLQESGGGFVKPGGSLKVSCAASGFTFSSYAMSWVRLSPEMRLEWVATISSAGGYIFYSDSVQGRFTISRDNAKNTLHLQMGSLRSGDTAMYYCARQGFGNYGDYYAMDYWGQGTTVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6626 - protein, 1115 aa, Artificial Sequence
  Synthetic Polypeptide encoding a CAR with optional accessory module(s)
MALPVTALLLPLALLLHAARPDIQMTQSPSSLSASVGDRVTITCRSSQNIVHSNGNTYLDWYQQTPGKAPKLLIYKVSNRFSGVPSRFSGSGSGTDFTFTISSLQPEDIATYYCFQYSHVPWTFGQGTKLQIGGGGSGGGGSGGGGSQVQLQQSGAEVKKPGSSVKVSCKASGYTFTNYYIYWVRQAPGQGLEWIGGINPTSGGSNFNEKFKTRVTITADESSTTAYMELSSLRSEDTAFYFCTRQGLWFDSDGRGFDFWGQGTTVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6627 - protein, 1011 aa, Artificial Sequence
  Synthetic Polypeptide encoding a CAR with optional accessory module(s)
MALPVTALLLPLALLLHAARPLFNQEVQIPLTESYCGPCPKNWICYKNNCYQFFDESKNWYESQASCMSQNASLLKVYSKEDQDLLKLVKSYHWMGLVHIPTNGSWQWEDGSILSPNLLTIIEMQKGDCALYASSFKGYIENCSTPNTYICMQRTVGGGGSGGGGDTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6628 - protein, 1105 aa, Artificial Sequence
  Synthetic Polypeptide encoding a CAR with optional accessory module(s)
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIKRGGGGSGGGGSGGGGSQVHLQESGPGLVKPSETLSLTCTVSDDSISSYYWSWIRQPPGKGLEWIGHISYSGSANYNPSLKSRVTISVDTSKNQFSLKLSSVTAADTAVYYCANWDDAFNIWGQGTMVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6629 - protein, 1107 aa, Artificial Sequence
  Synthetic Polypeptide encoding a CAR with optional accessory module(s)
MALPVTALLLPLALLLHAARPDVVMTQTPLTLSVTIGQPASISCKSSQSLLDSDGKTYLHWLLQRPGQSPKRLIFLVSKLDSGVPDRFTGSGSGTDFTLKISRVEAEDLGVYYCWQGTHFPQTFGGGTKLEIKGGGGSGGGGSGGGGSVQLQESGPDLVKPSQSLSLTCTVTGYSITSGYSWHWIRQFPGNKLEWMGYIHYSGDTDYNPSLKSRFSITRDTSKNQFFLQLNSVTTEDTATYYCATPGGFVYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6630 - protein, 1111 aa, Artificial Sequence
  Synthetic Polypeptide encoding a CAR with optional accessory module(s)
MALPVTALLLPLALLLHAARPDQSELTQPRSVSGSPGQSVTISCTGTERDVGGYNYVSWYQQHPGKAPKLIIHDVIERSSGVPDRFSGSKSGNTASLTISGLQAEDEADYYCWSFAGGYYVFGTGTDVTVLGGGGSGGGGSGGGGSFEVQLLESGGGLVQPGGSLRLSCAASGFTFSTYQMSWVRQAPGKGLEWVSGIVSSGGSTAYADSVKGRFTISRDNSKNTLYLQMNSLRAEDTAVYYCAGELLPYYGMDVWGQGTTVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6631 - protein, 1110 aa, Artificial Sequence
  Synthetic Polypeptide encoding a CAR with optional accessory module(s)
MALPVTALLLPLALLLHAARPDQSELTQPRSVSGSPGQSVTISCTGTERDVGGYNYVSWYQQHPGKAPKLIIHDVIERSSGVPDRFSGSKSGNTASLTISGLQAEDEADYYCWSFAGGYYVFGTGTDVTVLGGGGSGGGGSGGGGSEVQLLESGGGLVQPGGSLRLSCAASGFTFSTYEMHWVRQAPGKGLEWVSVILSSGGETNYADSVKGRFTISRDNSKNTLYLQMNSLRAEDTAVYYCAGMLLPYYGMDVWGQGTTVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6632 - protein, 1012 aa, Artificial Sequence
  Synthetic Polypeptide encoding a CAR with optional accessory module(s)
MALPVTALLLPLALLLHAARPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6633 - protein, 1107 aa, Artificial Sequence
  Synthetic Polypeptide encoding a CAR with optional accessory module(s)
MALPVTALLLPLALLLHAARPDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRGGGGSGGGGSGGGGSEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6634 - protein, 1108 aa, Artificial Sequence
  Synthetic Polypeptide encoding a CAR with optional accessory module(s)
MALPVTALLLPLALLLHAARPAIVMTQTPSPVSAAVGGTVTINCQASESVYSNNYLSWFQQKPGQPPKLLIYLASTLASGVPSRFKGSGSGTQFTLTISGVQCDDAATYYCIGGKSSSTDGNAFGGGTEVVVRGGGGSGGGGSGGGGSQSLEESGGRLVKPDETLTITCTVSGIDLSSNGLTWVRQAPGEGLEWIGTINKDASAYYASWAKGRLTISKPSSTKVDLKITSPTTEDTATYFCGRIAFKTGTSIWGPGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6635 - protein, 1106 aa, Artificial Sequence
  Synthetic Polypeptide encoding a CAR with optional accessory module(s)
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSGGGGSGGGGSQVQLVQSGAEVKKPGASVKVSCKASGYTFTSYDVHWVRQAPGQRLEWMGWLHADTGITKFSQKFQGRVTITRDTSASTAYMELSSLRSEDTAVYYCARERIQLWFDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6636 - protein, 1125 aa, Artificial Sequence
  Synthetic Polypeptide encoding a CAR with optional accessory module(s)
MALPVTALLLPLALLLHAARPDDIVMTQSPLSLPVTPGEPASISCRSSQSLLHSNGYNYLVWYLQKPGQSPQLLIYLGSIRASGVPDRFSGSGSGTDFTLKISRVEAEDVGVYYCMQPLQTPITFGQGTRLEIKRGGGGSGGGGSGGGGSGLQCVAAPRWVLSQVQLQQWGAGLLKPSETLSLTCAVYGGSFSGNYWSWIRQPPGKGLEWIGEINHSGSTNYNPSLKSRVTISVDTSKNQFSLKLSSVTAADTAVYYCARGGSYNYFDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6637 - protein, 1122 aa, Artificial Sequence
  Synthetic Polypeptide encoding a CAR with optional accessory module(s)
MALPVTALLLPLALLLHAARPDQLTQSPSSVSASVGDRVTITCRASRGISSWLAWYQQKPGKAPKLLIYTASSLQSGVPSRFSGSGSGTDFTLTISSLQPEDFATYYCQQAYSFPRTFGQGTKVEIKRGGGGSGGGGSGGGGSVAAPRWVLSQVQLQESGPGLVKPSQTLSLTCTVSGGSISSGGYYWIWIRQHPGKGLEWIGYIYYNGNTYYNPSLKSRVTMSVDTSKNQFSLKLSSVTAADTAVYYCARDGITMIRGYYYGMDVWGQGTTVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6638 - protein, 1096 aa, Artificial Sequence
  Synthetic Polypeptide encoding a CAR with optional accessory module(s)
MALPVTALLLPLALLLHAARPDIVVTQSPASLAVSLGQRATISYRASKSVSTSGYSYMHWNQQKPGQPPRLLIYLVSNLESGVPARFSGSGSGTDFTLNIHPVEEEDAATYYCQHIRELTRSEGGPSWKGGGGSGGGGSGGGGSEVKLEESGGDLVKPGGSLKLSCAASGFTFSGYGMSWVRQTPDKRLEWVATISSGGSYTYYPDSVKGRFTISRDNAKNTLYLQMSSLKSEDTAMYYCARHEGGYYGSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6639 - protein, 1112 aa, Artificial Sequence
  Synthetic Polypeptide encoding a CAR with optional accessory module(s)
MALPVTALLLPLALLLHAARPDDIQMTQSPSSLSASVGDRVTITCRASQGISNYLAWYQQKTGKVPKFLIYEASTLQSGVPSRFSGGGSGTDFTLTISSLQPEDVATYYCQNYNSAPFTFGPGTKVDIKGGGGSGGGGSGGGGSQVQLVESGGGVVQPGRSLRLSCAASGFAFSRYGMHWVRQAPGKGLEWVAVIWYDGSNKYYADSVKGRFTISRDNSKNTQYLQMNSLRAEDTAVYYCARGGDFLYYYYYGMDVWGQGTTVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6640 - protein, 1103 aa, Artificial Sequence
  Synthetic Polypeptide encoding a CAR with optional accessory module(s)
MALPVTALLLPLALLLHAARPDIQMTQSPSSLSTSVGDRVTLTCKASQDVGTAVDWYQQKPGPSPKLLIYWASTRHTGIPSRFSGSGSGTDFTLTISSLQPEDFADYYCQQYNSYPLTFGPGTKVDIKGGGGSGGGGSGGGGSEVQLVQSGPEVKKPGATVKISCKTSGYTFTEYTIHWVKQAPGKGLEWIGNINPNNGGTTYNQKFEDKATLTVDKSTDTAYMELSSLRSEDTAVYYCAAGWNFDYWGQGTLLTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6641 - protein, 1104 aa, Artificial Sequence
  Synthetic Polypeptide encoding a CAR with optional accessory module(s)
MALPVTALLLPLALLLHAARPDIQMTQSPSSLSASVGDRVTITCKASQDIYPYLNWFQQKPGKAPKTLIYRTNRLLDGVPSRFSGSGSGTDFTFTISSLQPYYCLQYDEFPLTFGAGTKLEIKRGGGGSGGGGSGGGGSQITLKESGPTLVKPTQTLTLTCTFSGFSLSTSNMGVGWIRQPPGKALEWLAHIWWDDDKYYSPSLKSRLTITKDTSKNQVVLTMTNMDPVDTATYYCVRSNYGYAWFAYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6642 - protein, 1104 aa, Artificial Sequence
  Synthetic Polypeptide encoding a CAR with optional accessory module(s)
MALPVTALLLPLALLLHAARPDIVMTQSQKFMSTSVGDRVNVTCKASQNVGTNVVWYQQKTGQSPKALIHSASYRYSGVPDRFTGSGSGTDFTLTLSNVQSEDLAEYFCQHYNSFPYTFGGGTKLEIKRGGGGSGGGGSGGGGSQVQLQQSGAELVRPGVSVKISCKGSGYRFTDYPIHWVKQSHAKSLEWIGIISTYYGDVTNNPKFRGKATMTVDKSSTTAYMELARLTSEDSAIYYCARNDLFAYWGQGTLVTVSATRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6643 - protein, 1107 aa, Artificial Sequence
  Synthetic Polypeptide encoding a CAR with optional accessory module(s)
MALPVTALLLPLALLLHAARPDIKMTQSPSSMYASLGERVTITCKASPDINSYLSWFQQKPGKSPKTLIYRANRLVDGVPSRFSGGGSGQDYSLTINSLEYEDMGIYYCLQYDEFPYTFGGGTKLEMKGGGGSGGGGSGGGGSEVKLVESGGGLVKPGGSLKLSCAASGFTFSSYAMSWVRQIPEKRLEWVASISRGGTTYYPDSVKGRFTISRDNVRNILYLQMSSLRSEDTAMYYCGRYDYDGYYAMDYWGQGTSVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6644 - protein, 1110 aa, Artificial Sequence
  Synthetic Polypeptide encoding a CAR with optional accessory module(s)
MALPVTALLLPLALLLHAARPDDVVVTPVSCFLSCISGAEGHHLIQGQQKCQYIWLLYALEPTETRTATQTPHLSCIQPRIWGPCQVQWQWVWDRLHPQHPSCGGGGCCNLLLSAHGAYTFGGGTRLELKGGGGSGGGGSGGGGSEVKLQESGPELVKPGASVKMSCKASGYTFTSYVMHWVKQKPGQGLEWIGYINPYNDGTKYNEKFKGKATLTSDKSSSTAYMELSSLTSEDSAVYYCARWKIYYGNYEDYWGQGTPLTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6645 - protein, 1140 aa, Artificial Sequence
  Synthetic Polypeptide encoding a CAR with optional accessory module(s)
MALPVTALLLPLALLLHAARPDEFQVQLVQSGGGLVQPGGSLRLSCAASDFDFAAYEMSWVRQAPGQGLEWVAIISHDGIDKYYTDSVKGRFTISRDNSKNTLYLQMNTLRAEDTATYYCLRLGAVGQGTLVTVSSLEGGGGSGGGGSGGGGSGSGGSGSGGSGSGGSGSGGSFEQVQLVQSGGGLVQPGGSLRLSCAASDFAFDDYEMSWVRQAPGKALEWIGDINHSGTTIYNPSLKSRVTISRDNSKNTLYLQMNTLRAEDTAIYYCARPHYGDYSDAFDIWGQGTMVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6646 - protein, 1115 aa, Artificial Sequence
  Synthetic Polypeptide encoding a CAR with optional accessory module(s)
MALPVTALLLPLALLLHAARPEIVMTQSPATLSVSPGERATLSCRASQSVSSNLAWYQQKPGQAPRLLIYGASTRATGIPARFSGSGSGTDFTLTISSLQSVDSAVYYCQQYNNWPPYTFGQGTKLEIKGGGGSGGGGSGGGGSQVQLLESGGGVVQPGRSLRLSCAASGFTFSFYGMHWVRQAPGKGLEWVAAISYDGSNKYYADSVKGRFTISRDNSKNTLYLQMNSLRAEDTAVYYCAKRPNQFYCSDGRCYSIDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6647 - protein, 1111 aa, Artificial Sequence
  Synthetic Polypeptide encoding a CAR with optional accessory module(s)
MALPVTALLLPLALLLHAARPQSVLTQPPSASAGGTPGQRVTISCSGSSSNIGSNFVYWYQQLPGTAPKLLIYRNNQRPSGVPDRFSGSRSGTSASLAGLRSEDEADYYCAADSLGGHYVFGTGTKVLGGGGSGGGGSGGGGSQVQLVESGGGSVQPGRSLRLSCEASGFTFEAYAMHWVRQPPGKGLEWVSSINWNSGRIAYADSVKGRFTISRDNARNSLYLQMNSLRLEDTAFYYCAKDIRRFSTGGAEFEYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6648 - protein, 1106 aa, Artificial Sequence
  Synthetic Polypeptide encoding a CAR with optional accessory module(s)
MALPVTALLLPLALLLHAARPENVLTQSPAIMSASPGEKVTMTCSASSSVSYMHWYQQKSSTSPKLWIYDTSKLASGVPGRFSGSGSGNSYSLTISSMEAEDVATYYCFQGSGYPLTFGAGTKLELKGGGGSGGGGSGGGGSQVQLKESGPGLVAPSQSLSITCTVSGFSLSSQGVYWVRQPPGKGLEWLGAIWAGGSTNYNSALMSRLSISKDNSKSQVFLKMNSLQTDDTAMYYCARVDGYRGYNMDYWGQGTSVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6649 - protein, 1110 aa, Artificial Sequence
  Synthetic Polypeptide encoding a CAR with optional accessory module(s)
MALPVTALLLPLALLLHAARPDDIQMTQSPSSLSASVGDRVTITCRASQSISSYLNWYQQKPGKAPKLLIYDASNLETGVPSRFSGSGSGTDFTFTISSLQPEDIATYYCQQYDNLPLTFGGGTKVDIKRGGGGSGGGGSGGGGSQVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARAHNSSSWSFDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6650 - protein, 1119 aa, Artificial Sequence
  Synthetic Polypeptide encoding a CAR with optional accessory module(s)
MALPVTALLLPLALLLHAARPDDVVMTQSPLSLPVSLGDQASISCRSSQRLVHSNGNTYLHWYLQKPGQSPKLLIYRVSNRFPGVPDRFSGSGSGTDFTLKISRVEAEDLGIYFCSQSTHVPYTFGGGTKLEIKRGGGGSGGGGSGGGGSEVRLQQSGPDLIKPGASVKMSCKASGYTFTGYVMHWVKQRPGQGLEWIGFINPYNDDIQSNERFRGKATLTSDKSSTTAYMELSSLTSEDSAVYYCARGAGYNFDGAYRFFDFWGQGTTLTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6651 - protein, 1110 aa, Artificial Sequence
  Synthetic Polypeptide encoding a CAR with optional accessory module(s)
MALPVTALLLPLALLLHAARPDSYELTQPPSVSVSPGQTATISCSGDQLGGKYGHWYQKKPGQSPVLVLYQDRKRPAGIPERFSGSSSGNTITLTISGTQAVDEADYYCQAWDTNLGGVFGGGTKVTVLGQGGGGSGGGGSGGGGSQVQLVESGAEVKKPGASVKVSCKASGYTFTGYYMHWVRQAPGQGLEWMGRINPNSGGTNYAQKFQGRVTMTRDTSISTAYMELSRLRSDDTAVYYCASPRGRGSAFDIWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6652 - protein, 1113 aa, Artificial Sequence
  Synthetic Polypeptide encoding a CAR with optional accessory module(s)
MALPVTALLLPLALLLHAARPDNFMLTQPHSVSESPGKTVTISCTRSSGSIASKYVQWYQQRPGSSPTTVIYEDNQRPSGVPDRFSGSIDTSSNSASLTISGLRTEDEADYYCHSYDSNNHSVFGGGTKVTVLGQGGGGSGGGGSGGGGSEVQLVESGGGVVQPGGSLRLSCAASGFTFSSYAMSWVRQAPGKGLEWVSAISGSGGSTYYADSVKGRFSISRDNSKNTLYLQMNSLRAEDTAVYYCARTRSSGAFDIWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6653 - protein, 1108 aa, Artificial Sequence
  Synthetic Polypeptide encoding a CAR with optional accessory module(s)
MALPVTALLLPLALLLHAARPDIQMNQSPSSLSASLGDTITITCHASQNINVWLSWYQQKPGNIPKLLIYKASNLHTGVPSRFSGSGSGTGFTITISSLQPEDIATYYCQQGQSYPWTFGGGTKLEIKRGGGGSGGGGSGGGGSEVQLQQSGPELVKPGASVKISCKASGYSFTGYFMNWVKQSHGKSLEYIGRFNPYNGETLYNQKFKGKATLTVDKSSSTVHMELLSVTSEDSAVYYCGRSGNDDAMDYWGQGTSVTVSSATRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6654 - protein, 1109 aa, Artificial Sequence
  Synthetic Polypeptide encoding a CAR with optional accessory module(s)
MALPVTALLLPLALLLHAARPDDIQMTQSPSILSASVGDRVTITCRASQRFGDYLAWYQQKPGQAPKLLIYGASTLQSGVPSRFSGSGSGTEFTLTISGLQPEDFATYYCQQANSFPITFGKGTRLDIRRGGGGSGGGGSGGGGSQVQLVQSGAEVKKPGSSVKVSCKASGGTFSSYAISWVRQAPGQGLEWMGWINVGNGNAIYSQKFQGRVTITRDTSATTAYMELSSLRSEDTAVYYCARDGERAWDLDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6655 - protein, 1114 aa, Artificial Sequence
  Synthetic Polypeptide encoding a CAR with optional accessory module(s)
MALPVTALLLPLALLLHAARPDETTLTQSPGTLSLSPGERATLSCRASQSVSSSYLAWYQQKPGQAPRLLIYGASSRATGIPDRFSGSGSGTDFTLTISRLEPEDFAVYYCQQYGSSPYTFGQGTKLEIKRGGGGSGGGGSGGGGSQVQLVQSGGGVVQPGRSLRLSCAASGFTFSSYAMHWVRQAPGKGLEWVAVISYDGSNKYYADSVKGRFTISRDNSKNTLYLQMNSLRAEDTAVYYCARELRFLEWSSDAFDIWGQGTMVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6656 - protein, 1109 aa, Artificial Sequence
  Synthetic Polypeptide encoding a CAR with optional accessory module(s)
MALPVTALLLPLALLLHAARPEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKGGGGSGGGGSGGGGSQLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTMIRGVIDSWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6657 - protein, 1106 aa, Artificial Sequence
  Synthetic Polypeptide encoding a CAR with optional accessory module(s)
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSGGGGSGGGGSQVQLVQSGAEVRKPGSSVKVSCKASGGSFNNYPIFWVRQAPGQGFEWMGRIIPILGITAYAQKFQGRVTITADKSTSTAYMELNSLRSEDTAVYYCAGGDDLDAFDIWGQGTMVSVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6658 - protein, 1118 aa, Artificial Sequence
  Synthetic Polypeptide encoding a CAR with optional accessory module(s)
MALPVTALLLPLALLLHAARPDIVMTQTPLSLPVTPGEPASISCRSSRSLLDSDDGNTYLDWYLQKPGQSPQLLIYTLSYRASGVPDRFSGSGSGTDFTLKISRVEAEDVGVYYCMQRVEFPITFGQGTRLEIKRGGGGSGGGGSGGGGSQVQLVESGGGVVQPGRSLRLSCAASGFIFSRYGMHWVRQAPGKGLKWVAVIWYDGSNKLYADSVKGRFTISRDNSKNTLYLQMNSLRAEDTAVYYCARDYYDNSRHHWGFDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6659 - protein, 1108 aa, Artificial Sequence
  Synthetic Polypeptide encoding a CAR with optional accessory module(s)
MALPVTALLLPLALLLHAARPEIQMTQSPSSMSASLGDTITITCQATQDIFKNLNWYQQKPGKPPSLLIYYATELAEGVPSRFSGSGSGSDYSLTISNLESEDFAAYYCLQFFEFPFTFGSGTKLEMKGGGGSGGGGSGGGGSQVQLQQSGAELVRPGTSVKVSCKASGYVFTNYWIEWIKQRPGQGLEWIGVMNPGSGETTYNEKFKGKATLTADKSSSTAYMQLSSLTSVDSAVYFCARDHDRDYYAMDYWGQGTSVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6660 - protein, 1105 aa, Artificial Sequence
  Synthetic Polypeptide encoding a CAR with optional accessory module(s)
MALPVTALLLPLALLLHAARPDILLTQSPAILSVSPGERVSFSCRASQNIGTSIHWYQQRTNGSPRLLIKYASESVSGIPSRFSGSGSGTDFTLSINSVESEDIADYYCQHTNSWPTTFGGGTKLEIKRGGGGSGGGGSGGGGSQVQLQQSDAELVKPGASVKISCKASGYTFTDHAIHWVKQKPEQGLEWIGYFSPGNGDIKYNEKFKGKATLTADKSSSTAYMQLNSLTSEDSAVYFCKRSYGNYDYWGQGTTLTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6661 - protein, 1110 aa, Artificial Sequence
  Synthetic Polypeptide encoding a CAR with optional accessory module(s)
MALPVTALLLPLALLLHAARPDIVMTQSPDSLAVSLGERATINCKSSQSLLNSGDQKNYLTWYQQKPGQPPKLLIYWASTRESGVPDRFSGSGSGTDFTLTISSLQAEDVAVYYCQNDYSYPLTFGQGTKVEIKGGGGSGGGGSGGGGSQVQLVQSGAEVKKTGSSVKVSCKASGYTFTDHAIHVWRQAPGQALEWMGHFSPGNTDIKYNDKFKGRVTLTVDRSMSTAYMELSSLRSEDTAMYYCKTSTFFFDYWGQGTMVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6662 - protein, 1032 aa, Artificial Sequence
  Synthetic Polypeptide encoding a CAR with optional accessory module(s)
MELTELLLVVMLLLTARLTLSSPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQLPPQGRTTAHKDPNAIFLSFQHLLRGKVRFLMLVGGSTLCVRRAPPTTAVPSRTSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6663 - protein, 1109 aa, Artificial Sequence
  Synthetic Polypeptide encoding a CAR with optional accessory module(s)
MALPVTALLLPLALLLHAARPDIQMTQSPSSLSASVGDRVTITCKASQDVSIAVAWYQQKPGKAPKVLIYSASYRYTGVPDRFSGSGSGTDFTFTISSLQPEDIAVYYCQQHYITPLTFGGGTKVEIKGGGGSGGGGSGGGGSQIQLVQSGHEVKKPGASVKVSCKASGYTFTNYGMNWVRQAPGQGLEWMGWINTKTGEPTYAEEFKGRFVFSLETSASTAYLQISSLKAEDTAMYFCGRGGYGSSYWYFDVWGQGTTVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6664 - protein, 1111 aa, Artificial Sequence
  Synthetic Polypeptide encoding a CAR with optional accessory module(s)
MALPVTALLLPLALLLHAARPDIVMTQSPDSLAVSLGERATINCRASKSVSTSGYSYMHWYQQKPGQPPKLLIYLASNLESGVPDRFSGSGSGTDFTLTISSLQAEDVAVYYCQHSRELPYTFGQGTKLEIKGGGGSGGGGSGGGGSQVQLQESGPGLVKPSETLSLTCTVSGGSISSYGVHWIRQPPGKGLEWIGVIWTSGVTDYNSALMGRVTISVDTSKNQFSLKLSSVTAADTAVYYCARDGDYDRYTMDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6665 - protein, 1090 aa, Artificial Sequence
  Synthetic Polypeptide encoding a CAR with optional accessory module(s)
MTALFLMSMLFGLACGQAMSFCIPTEYTMHIERRECAYCLTINTTICAGYCMTRDINGKLFLPKYALSQDVCTYRDFIYRTVEIPGCPLHVAPYFSYPVALSCKCGKCNTDYSDCIHEAIKTNYCTKPQKSYLVGFSVGGGGSGGGGSGGGGSAPDVQDCPECTLQENPFFSQPGAPILQCMGCCFSRAYPTPLRSKKTMLVQKNVTSESTCCVAKSYNRVTVMGGFKVENHTACHCSTCYYHKSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6666 - protein, 1107 aa, Artificial Sequence
  Synthetic Polypeptide encoding a CAR with optional accessory module(s)
MALPVTALLLPLALLLHAARPQSVLTQPPSVSVSPGQTASITCSGDKLGDKYACWYQQKPGQSPVLVIYQDSKRPSGIPERFSGSNSGNTATLTISGTQAMDEADYYCQAWDSSTAVVFGGGTKLTVLGGGGSGGGGSGGGGSQVQLVQSGAEVKKPGQSLKISCKASGYSLTDNWIGWVRQKPGKGLEWMGIIYPGDSDTRYSPSFQGQVTISADKSINTAYLQWSSLKASDTAIYYCVGLDWNYNPLRYWGPGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6667 - protein, 1105 aa, Artificial Sequence
  Synthetic Polypeptide encoding a CAR with optional accessory module(s)
MALPVTALLLPLALLLHAARPDIVMTQSQKFMSTSVGDRVSIICKASQNVGTFVAWYQQKPGQSPKLLVYSASNRYTGVPDRFTGSGSGTDFTLTINNMQSEDLADYFCRQYSSYPYTFGGGTKLEIKGGGGSGGGGSGGGGSEVQLQQSGPELVKPGASMKISCKASGYSFSAYTMNWVKQSHGKNLEWIGLINPYNGGTNYNQEFEGKATLTVNKSSNTAFMELLSLTSDDSAVYYCARRDWDYFDYWGQGTTLTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6668 - protein, 1116 aa, Artificial Sequence
  Synthetic Polypeptide encoding a CAR with optional accessory module(s)
MALPVTALLLPLALLLHAARPAIQMTQSPSSLSASVGDRVTITCRASQSISNYLNWYQQKPGKAPKLLIYAASSLQSGVPSRFSGSGSGTDFTLTISSLQPEDFATYYCQQSYSSPSTTFGQGTKLEIKRGGGGSGGGGSGGGGSEVQLVESGGGLIQPGGSLRLSCAASGFTVSSNYMSWVRQAPGKGLEWVSVTYSGGSTSYADSVKGRFTISRDNSKNTLYLQMNSLRAEDTAVYYCARGGRYCSSISCYARSGCDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6669 - protein, 1111 aa, Artificial Sequence
  Synthetic Polypeptide encoding a CAR with optional accessory module(s)
MALPVTALLLPLALLLHAARPDIQMTQSPSSLSASVGDRVTITCRASQSIGTSLHWYQQKPGKAPKLLIKFASRLQSGVPSRFSGSGSGTDFTLTISSLQPEDFATYYCQQSPGFPPTFGQGTKLEIKRGGGGSGGGGSGGGGSQVQLVESGGGLVKPGGSLRLSCAASGFSITTSGYYWTWIRQFPGKGLEWMGYIGYNSKTYYNPALKSRITISRDNAKNSLYLQMNSLRAEDTAVYYCARSLYGGYKDAFDSWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6670 - protein, 1116 aa, Artificial Sequence
  Synthetic Polypeptide encoding a CAR with optional accessory module(s)
MALPVTALLLPLALLLHAARPDEIVLTQSPLSLPVTPGEPASISCRSSQSLLHSIGYNYLDWYLQKPGQSPQLLIYLGSNRASGVPDRFSGSGSGTDFTLKISRVEAEDVGVYYCMQALQTPLTFGGGTKVEIKRGGGGSGGGGSGGGGSEVQLVESGGGVVQPGRSLRLSCAASGFTFRSYGMHWVRQAPGKGLEWVAVISYDGSNKYYTDSVNGRFTISRDNSKNTLYLQMNSLRAEDTAVYYCARGGGYYETSGPDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6671 - protein, 1114 aa, Artificial Sequence
  Synthetic Polypeptide encoding a CAR with optional accessory module(s)
MALPVTALLLPLALLLHAARPDDVVMTQSPLSLPVTPGEPASISCRSSQSLLHSIGYNYLHWFLQKPGQSPQLLIYLGSNRASGVPDRFSGSGSGTDFTLKISRVEAEDVGVYYCMQALQTPPTFGQGTRLEIKRGGGGSGGGGSGGGGSQLQLQESGPGLVKPSGTLSLTCAVSGGSISSSNWWSWVRQPPGKGLEWIGEIYHSGSTNYNPSLKSRVTISVDKSKNQFSLKLSSVTAADTAVYYCVGSPYGDYVLDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6672 - protein, 1117 aa, Artificial Sequence
  Synthetic Polypeptide encoding a CAR with optional accessory module(s)
MALPVTALLLPLALLLHAARPDVVMTQSPLSLPVTPGEPASISCRSSQSLLHSNGHNYLDWYLQKPGQSPQLLIYLGSNRASGVPDRFSGSGSGTDFTLKISRVEAEDVGVYYCMQTLQTPLTFGPGTKVDIKRGGGGSGGGGSGGGGSEVQLVETGGGVVQPGRSLRLSCAASGFTFSSYGMHWVRQAPGKGLEWVAVISYDGSNKYYADSVKGRFTISRDNSKNTLYLQMNSLRAEDTAVYYCAKDRYGWGSSFGHFDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6673 - protein, 1112 aa, Artificial Sequence
  Synthetic Polypeptide encoding a CAR with optional accessory module(s)
MALPVTALLLPLALLLHAARPDEIVLTQSPGTLSLSLGERATLSCRASQSISSSFLAWYQQKPGQAPKLLIYAASTRATGIPDRFSGSGSGTDFTLTISRLEPEDFAVYYCQQYGRSLSFGGGTKVEVKGGGGSGGGGSGGGGSQVQLQQSGPGLVKPSQTLSLTCAISGDSVSGNSATWNWIRQSPSRGLEWLGRTYYRSKWNHDYAESVKSRITINPDTSKNQFSLQLNSVTPEDTAVYYCARGDSSSWYAFDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6674 - protein, 1112 aa, Artificial Sequence
  Synthetic Polypeptide encoding a CAR with optional accessory module(s)
MALPVTALLLPLALLLHAARPDQTVVTQPPSASGTPGQRVTISCSGSSSNIGSNYVYWYQQLPGTAPKLLIYRSNQRPSGVPDRFSGSKSGTSASLAISGPRSVDEADYYCAAWDDSLNGVVFGGGTKLTVLGGGGGSGGGGSGGGGSQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARRIPPYYGMDVWGQGTTVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6675 - protein, 1112 aa, Artificial Sequence
  Synthetic Polypeptide encoding a CAR with optional accessory module(s)
MALPVTALLLPLALLLHAARPDQSVVTQPPSVSVAPGKTARITCGRNNIGSKSVHWYQQKPGQAPVLVVYDDSDRPSGIPERFSGSNSGNTATLTISRVEAGDEADYYCQVWDSSSDHVVFGGGTKLTVLGGGGGSGGGGSGGGGSEVQLVQSGGGVVRPGGSLRLSCAASGFTFDDYGMSWVRQAPGKGLEWVSGINWNGGSTGYADSVRGRFTISRDNAKNSLYLQMNSLRAEDTALYYCARERGYGYHDPHDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6676 - protein, 1124 aa, Artificial Sequence
  Synthetic Polypeptide encoding a CAR with optional accessory module(s)
MALPVTALLLPLALLLHAARPEQKLISEEDLEFQAVVTQPPSASGTPGQRVTISCSGSSSNIGSNTVNWYQQVPGTAPKLLIYSNNQRPSGVPDRFSGSKSGTSASLAISGLQSEDEADYYCAAWDDSLNGWVFGGGTKLTVLGGGGSGGGGSGGGGSQMQLVQSGAEVKEPGESLRISCKGSGYSFTNFWISWVRQMPGKGLEWMGRVDPGYSYSTYSPSFQGHVTISADKSTSTAYLQWNSLKASDTAMYYCARVQYSGYYDWFDPWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6677 - protein, 1118 aa, Artificial Sequence
  Synthetic Polypeptide encoding a CAR with optional accessory module(s)
MALPVTALLLPLALLLHAARPEQKLISEEDLEFDIQMTQSPSTLSASVGDRVTITCRASQNINKWLAWYQQRPGKAPQLLIYKASSLESGVPSRFSGSGSGTEYTLTISSLQPDDFATYYCQQYNSYATFGQGTKVEIKRGGGGSGGGGSGGGGSQVQLVQSGAEVKKPGESLKISCKGSGYNFSNKWIGWVRQLPGRGLEWIAIIYPGYSDITYSPSFQGRVTISADTSINTAYLHWHSLKASDTAMYYCVRHTALAGFDYWGLGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6678 - protein, 1108 aa, Artificial Sequence
  Synthetic Polypeptide encoding a CAR with optional accessory module(s)
MALPVTALLLPLALLLHAARPEIVLTQSPGTLSLSPGERATLSCRASQSVSNTYLAWYHQRPGQAPRLLIYGASSRATGIPDRFSGSGSGTDFALTISSLEPEDFAVYYCQQYSNSWTFGQGTKVEIKRGGGGSGGGGSGGGGSQVQLVESGGGVVQPGRSLRLSCAASGFTFSSYDMHWVRQAPGKGLEWVAVISYDGTNEYYADSVKGRFTISRDTSKNTLYLQMNSLRAEDTAVYYCARERYFDWSFDYWGQGTLVSVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6679 - protein, 1107 aa, Artificial Sequence
  Synthetic Polypeptide encoding a CAR with optional accessory module(s)
MALPVTALLLPLALLLHAARPELTQDPAVSVALGQTVRITCQGDSLRSNYANWYQQKPGQAPVLVIYGQNNRPSGIPDRFSGSSSGNTASLTITGAQAADEADYYCDSRVSTGNHVVFGGGTKLTVLGQGGGGSGGGGSGGGGSEVQLVQSGAEVKKPGASVKVSCKASGYTFTSYAMHWVRQAPGQRLEWMGWINAGNGNTKYSQKFQGRVTITRDTSASTAYMELSSLRSEDTAVYYCARDISYGSFDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6680 - protein, 1109 aa, Artificial Sequence
  Synthetic Polypeptide encoding a CAR with optional accessory module(s)
MALPVTALLLPLALLLHAARPDIVLTQTPATLSVTPGDSVSLSCRASQSISNNLHWYQQKSHESPRLLIKNASQSISGIPSKFSGSGSGTDFTLRINSVETEDFGMYFCQQSNSWPYTFGSGTKLEIKGGGGSGGGGSGGGGSQVKLQQSGPELVKPGASVKISCKASGYSFTGYYMHWVKQSHGNILDWIGYIYPYNGVSSYNQKFKGKATLTVDKSSSTAYMELRSLTSEDSAVYYCARERGLYQLRAMDYWGQGTSVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6681 - protein, 1100 aa, Artificial Sequence
  Synthetic Polypeptide encoding a CAR with optional accessory module(s)
MALPVTALLLPLALLLHAARPDIVMTQTPAIMSASPGQKVTITCSASSSVNYMHWYQQKLGSSPKLWIYDTSKLAPGVPARFSGSGSGTSYSLTISSMEAEDAASYFCHQWSSYPYTFGSGTKLEIKGGGGSGGGGSGGGGSEVQLQESGPDLVKPSQSLSLTCTVTGYSITSGYGWHWIRQFPGNKLEWMGYIHYSGSTTYNPSLKSRISISRDTSKNQFFLQLNSVTTEDTATYYCARSLRYWGQGTTLTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6682 - protein, 1103 aa, Artificial Sequence
  Synthetic Polypeptide encoding a CAR with optional accessory module(s)
MALPVTALLLPLALLLHAARPDIQMTQSPSSLSASVGDRVTITCSATSSISYMHWYQQKPGKAPKGWIYDTSKLAHGVPSRFSGSGSGTDFTLTISSLQPEDFATYYCHQRRSYPFTFGQGTKVEIKGGGGSGGGGSGGGGSEVQLVQSGAEVKKPGASVKVSCKASGYTFTNFWIHWVRQAPGQGLEWIGEIDPSDSYTNYNQKFKGRVTITRDTSTSTAYLELSSLRSEDTAVYYCAREITTVDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6683 - protein, 1110 aa, Artificial Sequence
  Synthetic Polypeptide encoding a CAR with optional accessory module(s)
MALPVTALLLPLALLLHAARPDIQMTQSPSSLSASVGDRVTITCKASQGFNKYVAWYQQKPGKAPKLLIYYTSTLQPGVPSRFSGSGSGRDYTLTISSLQPEDFATYYCLQYGNLLYAFGQGTKVEIKRGGGGSGGGGSGGGGSEVQLVQSGAEVKKPGASVKVSCKASGYTFTSYWIGWVRQAPGQGLEWIGDIYPGGGYTNYNEKFKGRVTITRDTSTSTAYLELSSLRSEDTAVYYCARLDGSSYRGAMDSWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6684 - protein, 1114 aa, Artificial Sequence
  Synthetic Polypeptide encoding a CAR with optional accessory module(s)
MALPVTALLLPLALLLHAARPDIQLTQSPSSLSASVGDRVTITCRASQSVDYDGDSYMNWYQQKPGKAPKLLIYAASYLESGVPSRFSGSGSGTDFTLTISSLQPEDFATYYCQQSHEDPYTFGQGTKVEIKRGGGGSGGGGSGGGGSEVQLVESGGGLVQPGGSLRLSCAVSGYSITSGYSWNWIRQAPGKGLEWVASITYDGSTNYNPSVKGRITISRDDSKNTFYLQMNSLRAEDTAVYYCARGSHYFGHWHFAVWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6685 - protein, 1106 aa, Artificial Sequence
  Synthetic Polypeptide encoding a CAR with optional accessory module(s)
MALPVTALLLPLALLLHAARPDIQMTQSPSSLSASVGDRVTITCRASQDIRYYLNWYQQKPGKAPKLLIYVASSLQSGVPSRFSGSGSGTEFTLTVSSLQPEDFATYYCLQVYSTPRTFGQGTKVEIKGGGGSGGGGSGGGGSEVQLVESGGGLAKPGGSLRLSCAASGFRFTFNNYYMDWVRQAPGQGLEWVSRISSSGDPTWYADSVKGRFTISRENAKNTLFLQMNSLRAEDTAVYYCASLTTGSDSWGQGVLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6686 - protein, 1107 aa, Artificial Sequence
  Synthetic Polypeptide encoding a CAR with optional accessory module(s)
MALPVTALLLPLALLLHAARPEIVMTQSPATLSVSPGERATLSCRASQSVSRNLAWYQQKPGQAPRLLIYGASTRATGIPARFSGSGSGTEFTLTIGSLQSEDFAVYYCQQYKTWPRTFGQGTNVEIKGGGGSGGGGSGGGGSQVQLQQWGAGLLKPSETLSLTCAVFGGSFSGYYWSWIRQPPGKGLEWIGEINHRGNTNDNPSLKSRVTISVDTSKNQFALKLSSVTAADTAVYYCARERGYTYGNFDHWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6687 - protein, 1108 aa, Artificial Sequence
  Synthetic Polypeptide encoding a CAR with optional accessory module(s)
MALPVTALLLPLALLLHAARPEIVMTPSSATLSVSPGERATLSCRASQSVSRNLAWYQQKPGQAPRLLIYGASTRATGIPARFSGSGSGTEFTLTISSLQSEDFAVYYCHQYSNWMCSFGQGTKLEIKGGGGSGGGGSGGGGSEVQLLESGGGLVQPGGSLRLSCAASGFTFSRYAMNWVRQAPGKGLEWVSGISGSGGRTYYADSVKGRFTISRDNSKNTLYLQMNSLRAEDTAVYYCAKDRDFWSGPFDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6688 - protein, 1108 aa, Artificial Sequence; identical to SEQ ID NO: 6687
  Synthetic Polypeptide encoding a CAR with optional accessory module(s)

SEQ ID NO: 6689 - protein, 1110 aa, Artificial Sequence
  Synthetic Polypeptide encoding a CAR with optional accessory module(s)
MALPVTALLLPLALLLHAARPQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSELVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6690 - protein, 1111 aa, Artificial Sequence
  Synthetic Polypeptide encoding a CAR with optional accessory module(s)
MALPVTALLLPLALLLHAARPEVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDKGGGYYDFWSGSDYWGQGTLVTVSSGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCNSRDSSGWVFGGGTKLTVLTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6691 - protein, 1120 aa, Artificial Sequence
  Synthetic Polypeptide encoding a CAR with optional accessory module(s)
MALPVTALLLPLALLLHAARPEVQLQQSGPGLVKPSQTLSLTCAISGDSVLSNSDTWNWIRQSPSRGLEWLGRTYHRSTWYDDYASSVRGRVSINVDTSKNQYSLQLNAVTPEDTGVYYCARDRLQDGNSWSDAFDVWGQGTMVTVSSGGGGSGGGGSGGGGSQSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLVYVFGTGTKVTVLTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6692 - protein, 1118 aa, Artificial Sequence
  Synthetic Polypeptide encoding a CAR with optional accessory module(s)
MALPVTALLLPLALLLHAARPQVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARGDSNYWSYYGMDVWGQGTLVTVSSGGGGSGGGGSGGGGSGGGGSQSVLTQPRSVSGSPGQSVTISCTGTSSDVGGYNYVSWYQQHPGEAPKLIIYDADKRPSGISNRFSSGKSGNTASLTISGLQVEDEADYYCCSYAGGSTWVFGGGTKVTVLTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6693 - protein, 1120 aa, Artificial Sequence
  Synthetic Polypeptide encoding a CAR with optional accessory module(s)
MALPVTALLLPLALLLHAARPEVQLQQSGPGLVKPSQTLSLTCAISGDSVSSNSAAWNWIRQSPSRGLEWLGRTYYRSKWYSDYAVSVKSRITINPDTSKNQFSLQLNSVTPEDTAVYYCARDPYDFWSGYPDAFDIWGQGTMVTVSSGGGGSGGGGSGGGGSQSALTQPASVSGSPGQSITISCTGTSSDVGGYNYVSWYQQHPGKAPKVIISEVNNRPSGVSHRFSGSKSGNTASLTISGLQAEDEADYFCSSYTSGRTLYVFGTGSKVTVLGTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6694 - protein, 1119 aa, Artificial Sequence
  Synthetic Polypeptide encoding a CAR with optional accessory module(s)
MALPVTALLLPLALLLHAARPEVQLQQSGPGLVKPSQTLSLTCAISGDSMLSNSDTWNWIRQSPSRGLEWLGRTYHRSTWYDDYASSVRGRVSINVDTSKNQYSLQLNAVTPEDTGVYYCARVRLQDGNSWSDAFDVWGQGTMVTVSSGGGGSGGGGSGGGGSQSALTQPASASGSPGQSVTISCTGTSSDVGGYNYVSWYQQHPGKAPKLMIYDVSNRPSGVSNRFSGSKSGNTASLTISGLQAEDEADYYCSSYTSSSTLYVFGTGTQLTVLTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6695 - protein, 1110 aa, Artificial Sequence; identical to SEQ ID NO: 6689
  Synthetic Polypeptide encoding a CAR with optional accessory module(s)

SEQ ID NO: 6696 - protein, 1119 aa, Artificial Sequence
  Synthetic Polypeptide encoding a CAR with optional accessory module(s)
MALPVTALLLPLALLLHAARPDVMLTQTPLSLPVSLGDQASISCRSSQSILHSTGDTYLEWYLQKPGQSPKLLINKVSNRLSGVPDRFSGSGSGTDFTLKISRVEAEDLGVYYCFQGSHVPWTFGGGTKLEIKRADAAPTVSIFPGGGGSGGGGSGGGGSQVKLQQSGPSLVKPGASVKMSCKASGYTFTDFYMKWVKQSHGKSLEWIGDINPNIGDTFYNQKFKGKATLTVDKSSSTAYMQLNSLTSEDSAVYFCSVGYFDVWGAGTTVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6697 - protein, 1115 aa, Artificial Sequence
  Synthetic Polypeptide encoding a CAR with optional accessory module(s)
MALPVTALLLPLALLLHAARPEIVLTQSPATLSLSPGERATLSCRASQSVSIYLAWYQQKPGQAPRLLIYDASNRATGIPARFSGSGSGTDFTLTISSLEPEDFAVYYCQQRSNWPPFTFGPGTKVDIKGGGGSGGGGSGGGGSQVQLVESGGGVVQPGRSLRLSCAASGFTFSSYGMHWVRQAPGKGLEWVAVIWDDGSNKYYVDSVKGRFTISRDNSKNTLYLQMNSLRAEDTAVYYCARDDYYGSGSFNSYYGTDVWGQGTTVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6698 - protein, 1100 aa, Artificial Sequence
  Synthetic Polypeptide encoding a CAR with optional accessory module(s)
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSGGGGSGGGGSEVQLVQSGGGLVHPGGSLRLSCAGSGFTFSTYLMYWVRQAPGKTLEWVSAIGSGGDTYYADSVKGRFTISRDNAKNSLYLQMNSLRAEDMAVYYCARGLGYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6699 - protein, 1119 aa, Artificial Sequence
  Synthetic Polypeptide encoding a CAR with optional accessory module(s)
MALPVTALLLPLALLLHAARPLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGGGGSGGGGSGGGGSEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6700 - protein, 1109 aa, Artificial Sequence
  Synthetic Polypeptide encoding a CAR with optional accessory module(s)
MALPVTALLLPLALLLHAARPQSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSVFGTGTKVLVLGGGGSGGGGSGGGGSQVQLVQSGAEVKKPGSSVKVSCKASGGTFSSYTINVWRQAPGQGLEWMGGFIPISGTVNYAQKFQGRVTITADESTSTAYMELSSLRSEDTAVYYCARPLDWTEDIWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6701 - protein, 1112 aa, Artificial Sequence
  Synthetic Polypeptide encoding a CAR with optional accessory module(s)
MALPVTALLLPLALLLHAARPNFMLTQPHSVSESPGKTVTISCTGSSGSIASNYVQWYQQRPGSAPTILIYEDNKRPSGVPDRFSGSIDSSSNSASLTISGLKTGDEADYYCQSYDDINHWVFGGGTKLTVLGGGGGSGGGGSGGGGSEVQLVQSGAEVKKPGASVKVSCKASGYTFTAYYLHWLRQAPGQGLEWMGWMNTNNGATRYAQKFQDRVTMTRDTSINTAYMEMSGLSSDDTAMYYCARGDISQDFADVWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6702 - protein, 1104 aa, Artificial Sequence
  Synthetic Polypeptide encoding a CAR with optional accessory module(s)
MALPVTALLLPLALLLHAARPQIVLTQSPAIMSASPGEKVTITCSASSSVSYMHWFQQKPGTSPKLWIYSTSNLASGVPARFSGSGSGTSYSLTISRMEAEDAATYYCQQRSSYPPTFGGGTKLEIKGGGGSGGGGSGGGGSQVQLQQSGAELMKPGASVKISCKATGYTFSSYWIEWVKQRPGHGLEWIGEILPGSGSTNYNEKFKGKATFTADTSSNTAYMQLSSLTSEDSAVYYCARYDYPWFAYWGQGTLVTVSATRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6703 - protein, 1112 aa, Artificial Sequence
  Synthetic Polypeptide encoding a CAR with optional accessory module(s)
MALPVTALLLPLALLLHAARPDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPFTFGSGTKLEIKGGGGSGGGGSGGGGSQVQLQQPGAELVRPGASVKLSCKASGYTFTSYWINWVKQRPGQGLEWIGNIYPSDSYTNYNQKFKDKATLTVDKSSSTAYMQLSSPTSEDSAVYYCTRSWRGNSFDYWGQGTTLTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6704 - protein, 1110 aa, Artificial Sequence
  Synthetic Polypeptide encoding a CAR with optional accessory module(s)
MALPVTALLLPLALLLHAARPDTQMTQSPSSVSASVGDRVTITCRTSQDISNYLNWYQQKPGKAPKLLIYNTSRLHSGVPSRFSGSGSGTDFTLTISSLQPEDFATYYCQQSNMFPYTFGQGTKLEIKGGGGSGGGGSGGGGSQVQLVQSGAEVKKPGASVKVSCKASGYTFNGYFMNWVRQAPGQGLERMGRINPNNGDSFYNQKFQGRVTMTRDTSTSTVYMELPSLRSEDTAVYYCAREGYYGGRGYALDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6705 - protein, 1115 aa, Artificial Sequence
  Synthetic Polypeptide encoding a CAR with optional accessory module(s)
MALPVTALLLPLALLLHAARPDIVMTQSPSSLAMSVGQKVTMTCKSSQSLLNSSNQKNYLAWYQQKPGQSPKLLVYFASTRESGVPDRFIGSGSGTDFTLTISSVQAEDLADYFCHQHYSTPLTFGAGTKLELKGGGGSGGGGSGGGGSEVQLQQSGPDLVKPGASVKMSCKASGYTFTSYVMHWVKQKPGQGLEWIGYIYPYNDGTKYNEKFKGKATLTSDKSSSTAYMELSSLTSEDSAVYYCAREEYGNYVRYFDVWGAGTTVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6706 - protein, 1109 aa, Artificial Sequence
  Synthetic Polypeptide encoding a CAR with optional accessory module(s)
MALPVTALLLPLALLLHAARPQSVVTQPPSVSAAPGQKVTISCSGSSSNIGNNYVSWYQQLPGTAPKLLIYDNNKRPSGIPDRFSASKSGTSATLGITGLQTRDEADYYCGTWDSSLSAWVFGGGTKLTVLGGGGGSGGGGSGGGGSQVQLVQSGAEVKKPGSSVKVSCKASGDTFSSYYISWVRQAPGQGLEWMGRIIPILGIANYAQKYQGRVTLSADKSTSTSYMELNSLSSEDTAVYYCALDWSYSIDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6707 - protein, 1115 aa, Artificial Sequence
  Synthetic Polypeptide encoding a CAR with optional accessory module(s)
MALPVTALLLPLALLLHAARPEFEVKLVESGGGLVKFGGSLKLSCAASGFTLSSYYMSWVRQSPEKRLELVAVINSNGGSTYYPDTVKGRFTISRDNAKNTLYLQMSSLKSEDTALYYCARPFYYSNSPFAYWGQGTLVTVSAGGGGSGGGGSGGGGSDVLMTQTPLSLPVSLGDQASISCRSSQSIVHRTGNTYLEWYLQKPGQSPKLLIYKVSNRFSGVPDRFSGSGSGTDFTLKISRVGAEDLGVYYCFQGSHVPYTFGGGTKLEIKTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6708 - protein, 1112 aa, Artificial Sequence
  Synthetic Polypeptide encoding a CAR with optional accessory module(s)
MALPVTALLLPLALLLHAARPELVMTQSPASLAVSLGQRATISCRASESVDSYGKSFMHWYQLKPGQPPKLLIYRASNLESGVPARFSGSGSRTDFTLTIDPVEADDAATYYCQQNNEDPWTFGGGTKLEIKGGGGSGGGGSGGGGSEVQLEQSGPELVKPGASVKMSCKASGYTFTNYYMKWVKQSHGKSLEWIGDLNPNNGDTFYNQKFKGKATLTVDKSSNTAYMQLNSLTSEDSAVYYCARTGRYEENAMDYWGQGTSVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6709 - protein, 1106 aa, Artificial Sequence
  Synthetic Polypeptide encoding a CAR with optional accessory module(s)
MALPVTALLLPLALLLHAARPDVVMTQSPSSLSASVGDRVTITCMASEDIYIRLAWYQQKPGNAPKLLIYAATSLETGVPSRFSGSGSGTDFTLTISSLQPEDFATYYCQQYWSSPWTFGGGTKVEIKGGGGSGGGGSGGGGSQVQLQESGPGLVKPSQTLSLTCTVSGYSITSDYTWNWIRQPPGNGLEWIGYITYSGSTSYNPSLKSRVLISVDTSKNQVSLKLSSVTAADTAVYYCARLGRRYTMDYWGQGTTVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6710 - protein, 1113 aa, Artificial Sequence
  Synthetic Polypeptide encoding a CAR with optional accessory module(s)
MALPVTALLLPLALLLHAARPDVLMTQTPVSLSVSLGDQASISCRSSQSIVHSTGNTYLEWYLQKPGQSPKLLIYKISNRFSGVPDRFSGSGSGTDFTLKISRVEAEDLGVYYCFQASHAPRTFGGGTKLEIKRGGGGSGGGGSGGGGSEVILVESGGGLVKPGGSLKLSCAASGFTFSSYTMSWVRQTPEKRLEWVATISSGGGNTYYPDSVKGRFTISRDNAKNNLYLQMSSLRSEDTALYYCARYYRYEAWFASWGQGTLVTVSATRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6711 - protein, 983 aa, Artificial Sequence
  Synthetic Polypeptide encoding a CAR with optional accessory module(s)
MALPVTALLLPLALLLHAARPQVKLEESGGGLVQAGRSLRLSCAASEHTFSSHVMGWFRQAPGKERESVAVIGWRDISTSYADSVKGRFTISRDNAKKTLYLQMNSLKPEDTAVYYCAARRIDAADFDSWGQGTQVTVSSQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6712 - protein, 982 aa, Artificial Sequence
  Synthetic Polypeptide encoding a CAR with optional accessory module(s)
MALPVTALLLPLALLLHAARPEVQLVESGGGLVQAGGSLRLSCAASGRTFTMGWFRQAPGKEREFVAAISLSPTLAYYAESVKGRFTISRDNAKNTVVLQMNSLKPEDTALYYCAADRKSVMSIRPDYWGQGTQVTVSSQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6713 - protein, 1116 aa, Artificial Sequence
  Synthetic Polypeptide encoding a CAR with optional accessory module(s)
MALPVTALLLPLALLLHAARPQVKLEESGGGLVQAGRSLRLSCAASEHTFSSHVMGWFRQAPGKERESVAVIGWRDISTSYADSVKGRFTISRDNAKKTLYLQMNSLKPEDTAVYYCAARRIDAADFDSWGQGTQVTVSSGGGGSGGGGSGGGGSEVQLVESGGGLVQAGGSLRLSCAASGRTFTMGWFRQAPGKEREFVAAISLSPTLAYYAESVKGRFTISRDNAKNTVVLQMNSLKPEDTALYYCAADRKSVMSIRPDYWGQGTQVTVSSQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6714 - protein, 980 aa, Artificial Sequence
  Synthetic Polypeptide encoding a CAR with optional accessory module(s)
MALPVTALLLPLALLLHAARPEVQLVESGGGLVQAGGSLRLSCIATGKVFSIYDMGWYRQAPGKQRELVAEITSSGTTHYDDFVSGRFTISRDNAKNTVYLQMNTLKAEDTAVYYCRANHVFGGSYWGQGTQVTVSSQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6715 - protein, 986 aa, Artificial Sequence
  Synthetic Polypeptide encoding a CAR with optional accessory module(s)
MALPVTALLLPLALLLHAARPQVQLVESGGGLVQPGGSLRLSCEASGFTLDYYAIGWFRQAPGKEREGVICISRSDGSTYYADSVKGRFTISRDNAKKTVYLQMISLKPEDTAAYYCAAGADCSGYLRDYEFRGQGTQVTVSSQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6716 - protein, 1109 aa, Artificial Sequence
  Synthetic Polypeptide encoding a CAR with optional accessory module(s)
MALPVTALLLPLALLLHAARPEVQLVESGGGLVQAGGSLRLSCIATGKVFSIYDMGWYRQAPGKQRELVAEITSSGTTHYDDFVSGRFTISRDNAKNTVYLQMNTLKAEDTAVYYCRANHVFGGSYWGQGTQVTVSSEVAALEKQVQLVESGGGLVQPGGSLRLSCEASGFTLDYYAIGWFRQAPGKEREGVICISRSDGSTYYADSVKGRFTISRDNAKKTVYLQMISLKPEDTAAYYCAAGADCSGYLRDYEFRGQGTQVTVSSQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6717 - protein, 992 aa, Artificial Sequence
  Synthetic Polypeptide encoding a CAR with optional accessory module(s)
MALPVTALLLPLALLLHAARPQVKLEESGGRLVQPRGSLRLSCAGSGRTFSTYGMAWFRQAPGKEREFVASKASMNYSGRTYYADSVKGRFTIARDNAKNMVFLQMNNLKPEDTAVYYCAAGTGCSTYGCFDAQIIDYWGKGTLVTVSSQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6718 - protein, 983 aa, Artificial Sequence
  Synthetic Polypeptide encoding a CAR with optional accessory module(s)
MALPVTALLLPLALLLHAARPQVKLEESGGGLVQPGESLRLSCSASGSIFKVFRVFAMSWYRQGPGKQRELVASISSGETTTYADSVKGRFTISRDNAKNTAYLQMDSLKPEDTAVYYCNADHTFTGDFWGQGTQVTVSSQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6719 - protein, 1118 aa, Artificial Sequence
  Synthetic Polypeptide encoding a CAR with optional accessory module(s)
MALPVTALLLPLALLLHAARPQVKLEESGGRLVQPRGSLRLSCAGSGRTFSTYGMAWFRQAPGKEREFVASKASMNYSGRTYYADSVKGRFTIARDNAKNMVFLQMNNLKPEDTAVYYCAAGTGCSTYGCFDAQIIDYWGKGTLVTVSSEVAALEKQVKLEESGGGLVQPGESLRLSCSASGSIFKVFRVFAMSWYRQGPGKQRELVASISSGETTTYADSVKGRFTISRDNAKNTAYLQMDSLKPEDTAVYYCNADHTFTGDFWGQGTQVTVSSQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6720 - protein, 981 aa, Artificial Sequence
  Synthetic Polypeptide encoding a CAR with optional accessory module(s)
MALPVTALLLPLALLLHAARPQVKLEESGGELVQPGGPLRLSCAASGNIFSINRMGWYRQAPGKQRAFVASITVRGITNYADSVKGRFTISVDKSKNTIYLQMNALKPEDTAVYYCNAVSSNRDPDYWGQGTQVTVSSQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6721 - protein, 993 aa, Artificial Sequence
  Synthetic Polypeptide encoding a CAR with optional accessory module(s)
MALPVTALLLPLALLLHAARPPVQLVESGGGLVQAGDSLRLSCAASGRTFGIGTMGWFRQPPGKEREFVAAIRWSTGGTRYADSVKGRFTISRDNAKLTVDLQMDSLKPEDTAVYYCAADRLSLDLSGRYHYNPAVYDYWGQGTQVTVSSQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6722 - protein, 1125 aa, Artificial Sequence
  Synthetic Polypeptide encoding a CAR with optional accessory module(s)
MALPVTALLLPLALLLHAARPQVKLEESGGELVQPGGPLRLSCAASGNIFSINRMGWYRQAPGKQRAFVASITVRGITNYADSVKGRFTISVDKSKNTIYLQMNALKPEDTAVYYCNAVSSNRDPDYWGQGTQVTVSSGGGGSGGGGSGGGGSPVQLVESGGGLVQAGDSLRLSCAASGRTFGIGTMGWFRQPPGKEREFVAAIRWSTGGTRYADSVKGRFTISRDNAKLTVDLQMDSLKPEDTAVYYCAADRLSLDLSGRYHYNPAVYDYWGQGTQVTVSSQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6723 - protein, 983 aa, Artificial Sequence
  Synthetic Polypeptide encoding a CAR with optional accessory module(s)
MALPVTALLLPLALLLHAARPAVQLVESGGGLVQAGDSLRLTCTASGRAFSTYFMAWFRQAPGKEREFVAGIAWSGGSTAYADSVKGRFTISRDNAKNTVYLQMNSLKSEDTAVYYCASRGIEVEEFGAWGQGTQVTVSSQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6724 - protein, 984 aa, Artificial Sequence
  Synthetic Polypeptide encoding a CAR with optional accessory module(s)
MALPVTALLLPLALLLHAARPQVQLVESGGGLVQAGGSLRLSCAASGGTLSKNTVAWFRQAPGKERGFVASITWDGRTTYYADSVKGRFTISRDNAKNTVYLQMNSLKPEDTAVYVCADLGKWPAGPADYWGQGTQVTVSSQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6725 - protein, 1110 aa, Artificial Sequence
  Synthetic Polypeptide encoding a CAR with optional accessory module(s)
MALPVTALLLPLALLLHAARPAVQLVESGGGLVQAGDSLRLTCTASGRAFSTYFMAWFRQAPGKEREFVAGIAWSGGSTAYADSVKGRFTISRDNAKNTVYLQMNSLKSEDTAVYYCASRGIEVEEFGAWGQGTQVTVSSPGGGGSPQVQLVESGGGLVQAGGSLRLSCAASGGTLSKNTVAWFRQAPGKERGFVASITWDGRTTYYADSVKGRFTISRDNAKNTVYLQMNSLKPEDTAVYVCADLGKWPAGPADYWGQGTQVTVSSQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6726 - protein, 1138 aa, Artificial Sequence
  Synthetic Polypeptide encoding a CAR with optional accessory module(s)
MALPVTALLLPLALLLHAARPAVQLVESGGGLVQAGDSLRLTCTASGRAFSTYFMAWFRQAPGKEREFVAGIAWSGGSTAYADSVKGRFTISRDNAKNTVYLQMNSLKSEDTAVYYCASRGIEVEEFGAWGQGTQVTVSSPGGGGSPQVQLVESGGGLVQAGGSLRLSCAASGGTLSKNTVAWFRQAPGKERGFVASITWDGRTTYYADSVKGRFTISRDNAKNTVYLQMNSLKPEDTAVYVCADLGKWPAGPADYWGQGTQVTVSSEVAALEKEVAALEKEVAALEKEVAALEKQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6727 - protein, 1112 aa, Artificial Sequence
  Synthetic Polypeptide encoding a CAR with optional accessory module(s)
MALPVTALLLPLALLLHAARPEIVLTQSPATLSLSPGERATLSCSASSSVSYMYWYQQKPGQAPRLLIYRTSNLASGIPARFSGSGSGTDFTLTISSLEPEDFAVYYCQQYHSYPTTFGQGTKVEIKRTVGGGGSGGGGSGGGGSEVQLVESGGGLVQPGGSLRLSCAASGFSFNTYAMNWVRQAPGKGLEWVSHIRSKSNNFATYYADSVKDRFTISRDNAKNSLYLQMNSLRAEDTAVYYCARQGGDFPMDYWGQGTLVTVSSTRTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6728 - protein, 1106 aa, Artificial Sequence
  Synthetic Polypeptide encoding a CAR with optional accessory module(s)
MALPVTALLLPLALLLHAARPDVVMTQSPSSLSASVGDRVTITCKASEDIYIRLAWYQQKPGKAPKLLIYAATSLETGVPSRFSGSGSGTDFTLTISSLQPEDFATYYCQQYWTTPWTFGGGTKVEIKGGGGSGGGGSGGGGSQVQLQESGPGLVKPSQTLSLTCTVSGYSITIDYTWNWIRQPPGKGLEWIGYITYSGSTDYNPSLKSRVLISVDTSKNQVSLKLSSVTAADTAVYYCARLGRRYALDYWGQGTTVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6729 - protein, 1111 aa, Artificial Sequence
  Synthetic Polypeptide encoding a CAR with optional accessory module(s)
MALPVTALLLPLALLLHAARPDIQLTQSPSFLSASVGDRVTITCRASQGISTDLNWYQQKPGKAPKLLIYAASNLESGVPSRFSGSGSGTEFTLTISSLQPEDFATYYCQQSYNWPYTFGGGTKVEIKRGGGGSGGGGSGGGGSEVQLVESGGGLVKPGGSLRLSCAASGFTFSNFEMNWVRQAPGKGLEWVSGISSNGRYINYADSVKGRFTISRDNAKNSLYLQMNSLRAEDTAVYYCARVVDFDQDYNGFDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6730 - protein, 1109 aa, Artificial Sequence
  Synthetic Polypeptide encoding a CAR with optional accessory module(s)
MALPVTALLLPLALLLHAARPDIQLTQSPSFLSASVGDRVTITCSLSLGISTWRDWFPPRLGRGLEPLTYAASTLQSGVPSRFSGSGSGTEFTLTISSLQPEDFATYYCQQLNSYPLTFGGGTKVEIKRGGGGSGGGGSGGGGSEVQLVESGGGLVKPGGSLRLSCAASGFTFSTYGMSWVRQAPGKGLEWVAYINNGSGYIYYADSVKGRFTISRDNAKNSLYLQMNSLRAEDTAVYYCARGQWWSGGDFDYWGQGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6731 - protein, 1091 aa, Artificial Sequence
  Synthetic Polypeptide encoding a CAR with optional accessory module(s)
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSRVQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6732 - protein, 1091 aa, Artificial Sequence
  Synthetic Polypeptide encoding a CAR with optional accessory module(s)
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6733 - protein, 1091 aa, Artificial Sequence
  Synthetic Polypeptide encoding a CAR with optional accessory module(s)
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6734 - protein, 1092 aa, Artificial Sequence
  Synthetic Polypeptide encoding a CAR with optional accessory module(s)
MALPVTALLLPLALLLHAARPDEIVLTQSPATLSLSPGERATLSCSASSSVSYMHWYQQKPGQAPRLLIYDTSKLASGIPARFSGSGSGTDFTLTISSLEPEDVAVYYCFQGSVYPFTFGQGTKLEIKRGGGGSGGGGSGGGGSQVQLQESGPGLVKPSQTLSLTCTVSGGSISTSGMGVGWIRQHPGKGLEWIGHIWWDDDKRYNPALKSRVTISVDTSKNQFSLKLSSVTAADTAVYYCARMELWSYYFDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6735 - protein, 1099 aa, Artificial Sequence
  Synthetic Polypeptide encoding a CAR with optional accessory module(s)
MALPVTALLLPLALLLHAARPDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6736 - protein, 1098 aa, Artificial Sequence
  Synthetic Polypeptide encoding a CAR with optional accessory module(s)
MALPVTALLLPLALLLHAARPDIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKRGGGGSGGGGSGGGGSEVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6737 - protein, 1096 aa, Artificial Sequence
  Synthetic Polypeptide encoding a CAR with optional accessory module(s)
MALPVTALLLPLALLLHAARPEIVLTQSPDFQSVTPKEKVTITCRASESVDTFGISFMNWFQQKPDQSPKLLIHAASNQGSGVPSRFSGSGSGTDFTLTINSLEAEDAATYYCQQSKEVPFTFGGGTKVEIKGGGGSGGGGSGGGGSEVQLVESGGGLVQPGGSLRLSCAASGFTFSSSWMNWVRQAPGKGLEWVGRIYPGDGDTNYNGKFKGRFTISRDDSKNSLYLQMNSLKTEDTAVYYCARSGFITTVLDFDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6738 - protein, 1092 aa, Artificial Sequence
  Synthetic Polypeptide encoding a CAR with optional accessory module(s)
MALPVTALLLPLALLLHAARPAIQLTQSPSSLSASVGDRVTITCRASQGISSAQQKPGKAPKLLILAWYSSLESGVPSRFSGYDASGSGTDFTLTISSLQPEDFATYYCQQFNSYPYTFGQGTKLEIKGGGGSGGGGSGGGGSEVQLVQSGAEVKKPGESLKISCKGSGYSFSSSWIGWVRQMPGKGLEWMGIIYPDDSDTRYSPSFQGQVTISADKSIRTAYLQWSSLKASDTAMYYCARHVTMIWGVIIDFWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6739 - protein, 1116 aa, Artificial Sequence
  Synthetic Polypeptide encoding a CAR with optional accessory module(s)
MALPVTALLLPLALLLHAARPINIYNAEPANPSEKNSPEFDIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKGGGGSGGGGSGGGGSEVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6740 - protein, 1098 aa, Artificial Sequence
  Synthetic Polypeptide encoding a CAR with optional accessory module(s)
MALPVTALLLPLALLLHAARPDILLTQSPATLSLSPGERATLSCRASQSVDYDGDSYLNWYQQKPGQPPKLLIYDASNLVSGIPPRFSGSGSGTDFTLTISRLEPEDFAVYHCQQSTEDPWTFGGGTKLEIKGGGGSGGGGSGGGGSQVQLVESGGGLVEPGGSLRLSCMSGYAFSSYWMNWVRQMPGKGLEWMGQIWPGDGDTNYNPSLKSRVTITADESTSTAYMELSSLKAEDTAVYFCARRETTTVGRYYYAMDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6741 - protein, 1095 aa, Artificial Sequence
  Synthetic Polypeptide encoding a CAR with optional accessory module(s)
MALPVTALLLPLALLLHAARPDILLTQSPATLSLSPGERATLSCRASQSVDNYGISFMNWYQQKPGQPPKLLIYAASNQGSGIPSRFSGSGSGTDFTLTISSLEPEDFAMYFCQQSNEVPRTFGGGTKLEIKGGGGSGGGGSGGGGSQVQLVESGGGLVEPGGSLRLSCMSGYAFSSSWMNWVRQMPGKGLEWMGRIYPGDGDTNYNGKFKERVTITADESTSTAYMELSSLKAEDTAVYFCARSEYWGNYWAMDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6742 - protein, 1094 aa, Artificial Sequence
  Synthetic Polypeptide encoding a CAR with optional accessory module(s)
MALPVTALLLPLALLLHAARPDILLTQSPATLSLSPGERATLSCKASQNVGTNVAWYQQKPGQPPKLLIYSATYRNSGIPARFSGSGSGTEFTLTITNVQSKDLADYFYFCQYNRYPYTSGGGTKLEIKRGGGGSGGGGSGGGGSQVQLVESGGGLVEPGGSLRLSCMSGYAFSSYWMNWVRQMPGKGLEWMGQIYPGDGDTNYNGKFKGRVTITADESTSTAYMELSSLKAEDTAVYFCARKTISSVVDFYFDNWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6743 - protein, 1107 aa, Artificial Sequence
  Synthetic Polypeptide encoding a CAR with optional accessory module(s)
MALPVTALLLPLALLLHAARPINIYNAEPANPSEKNSPEFQIVLTQSPATLSASPGEKATMTCSASSGVNYMHWYQQKPGTSPKRWIYDTDKTASGVPARFSGSGSGTSYSLTISSMEAEDAATYYCHQRGSYTFGGGTKLEIKGGGGSGGGGSGGGGSQVQLEQPGAEVVKPGASVKVSCKTSGYTFTSNWMHWVKQTPGKGLEWIGEIDPSDSYTNYNQKFDGKAKLTVDKSSSTAYMEVSDLTAEDSATYYCARGSNPYYYAMDYWGQGTSVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6744 - protein, 1093 aa, Artificial Sequence
  Synthetic Polypeptide encoding a CAR with optional accessory module(s)
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRGGGGSGGGGSGGGGSQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6745 - protein, 1101 aa, Artificial Sequence
  Synthetic Polypeptide encoding a CAR with optional accessory module(s)
MALPVTALLLPLALLLHAARPDDIQLTQSPSSLSASVGDRVTITCKASQSVDYDGDSYLNWYQQIPGKAPKLLIYDASNLVSGIPPRFSGSGSGTDYTFTISSLQPEDIATYHCQQSTEDPWTFGGGTKLQIKRGGGGSGGGGSGGGGSQVQLQQSGAEVKKPGSSVKVSCKASGYAFSSYWMNWVRQRPGQGLEWIGQIWPGDGDTNYNGKFKGRATITADESTNTAYMELSSLRSEDTAFYSCARRETTTVGRYYYAMDYWGQGTTVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6746 - protein, 1092 aa, Artificial Sequence
  Synthetic Polypeptide encoding a CAR with optional accessory module(s)
MALPVTALLLPLALLLHAARPQSVLTQPASVSGSPGQSITISCTGTSSDVGGYNYVSWYQQHPGKAPKLMIYDVNNRPSEVSNRFSGSKSGNTASLTISGLQAEDEADYYCSSYTTGSRAVFGGGTKLTVLGGGGGSGGGGSGGGGSEVQLVQSGAEVKKPGESLTISCKASGYSFPNYWITWVRQMSGGGLEWMGRIDPGDSYTTYNPSFQGHVTISIDKSTNTAYLHWNSLKASDTAMYYCARYYVSLVDIWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6747 - protein, 1098 aa, Artificial Sequence
  Synthetic Polypeptide encoding a CAR with optional accessory module(s)
MALPVTALLLPLALLLHAARPQSVVTQPPSVSAAPGQKVTISCSGSSSNIGNNYVSWYQQLPGTAPKLLIYDNNKRPSGIPDRFSGSKSGTSATLGITGLQTGDEADYYCGTWDGSLYTMLFGGGTKLTVLGGGGSGGGGSGGGGSEVQLVESGGGLVKPGGSLRLSCAASGFTFSNAWMSWVRQAPGKGLEWVGFIRSKAYGGTTEYAASVKGRFTISRDDSKSIAYLQMNNLKTEDTAVYYCARDGLYSSSWYDSDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6748 - protein, 1103 aa, Artificial Sequence
  Synthetic Polypeptide encoding a CAR with optional accessory module(s)
MALPVTALLLPLALLLHAARPQSVLTQPPSVSGAPGQRVTISCTGSSSNIGAGYDVHWYQQLPGTAPKLLIFGNSNRPSGVPDRFSGFKSGTSASLAITGLQAEDEADYFCQSYDSSLSGSGVFGTGTKVTVLGGGGGSGGGGSGGGGSQMQLVQSGGGLVQPGRSLRLSCAASGFTFDDYAMHWVRQAPGKGLEWVSGISWNSGSIGYADSVKGRFTISRDNAKNSLYLQMNSLRAEDTALYYCAKDIHSGSYYGLLYYAMDVWGQGTTVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6749 - protein, 1090 aa, Artificial Sequence
  Synthetic Polypeptide encoding a CAR with optional accessory module(s)
MALPVTALLLPLALLLHAARPDYIHVTQSPSSLSVSIGDRVTINCQTSQGVGSDLHWYQHKPGRAPKLLIHHASSVEDGVPSRFSGTGFHTSFNLTINDLQADDIGTYYCQVLQSFGRGSRLDTKGGGGSGGGGSGGGGSRAHLVQSGTAMKKPGASVRVSCQTSGYTFTAHILFWFRQAPGRGLEWVGWIKPQYGAVNFGGGFRDRVTLTRDVYREIAYMDIRGLKPDDTAVYYCARDRSYGDSSWALDAWGQGTTVVVSATRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6750 - protein, 1100 aa, Artificial Sequence
  Synthetic Polypeptide encoding a CAR with optional accessory module(s)
MALPVTALLLPLALLLHAARPDVQMIQTPDSLAVSLGQRATISCRASESVDNYGISFMHWYQQKPGQSPKLLIYRASNLESGIPARFSGSGSRTDFTLTINPVETDDVATYYCQQNNKDPPTFGGGTKLEIKGGGGSGGGGSGGGGSGGGGSQVQLQQSGAELVKPGASVKISCKASGYAFSSYWMNWVKQRPGKGLEWIGQIYPGDGDTTYNGKFKGKATLTADKSSSTVYMQLNSLTSEDSAVYFCVRYYYGSSGYFDYWGQGTTLTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6751 - protein, 1091 aa, Artificial Sequence
  Synthetic Polypeptide encoding a CAR with optional accessory module(s)
MALPVTALLLPLALLLHAARPDVQMIQTPSSLSASLGDRVTISCRASQDIGNYLNWYQQKPDGTVKLLIYYTSRLHSGVPSRFSGSGSGTEYSLTISNLEQEDIATYFCQQGSALPPTFGGGTKLEINGGGGSGGGGSGGGGSALQLQQSGAELVRPGASVTLSCKASGYTFTDYEMHWVKQTPVHGLEWIGAIDPETGGTAYNQKFEGKAILTADKSSSTAYMELRSLTSEDSPVYYCARRRYYGSSSFDYWGQGTTLTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6752 - protein, 1098 aa, Artificial Sequence
  Synthetic Polypeptide encoding a CAR with optional accessory module(s)
MRLPAQLLGLLMLWVSGSSGDVVMTQSPLSLPVTPGAPASISCRSSQSIVHSNGNTYLEWYLQKPGQSPKLLIYKVSNRFSGVPDRFSGSGSGTDFTLRISRVEAEDVGIYYCFQGSHVPPTFGPGTKLEIKGGGGSGGGGSGGGGSEVQLVESGGGLVQPGGSLRLSCSASGFTFSSFGMHWVRQAPGKGLEWVAYISSGSSTIYYGDTVKGRFTISRDNAKNSLFLQMSSLRAEDTAVYYCAREGGYYYGRSYYTMDYWGQGTTVTVSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6753 - protein, 1123 aa, Artificial Sequence
  Synthetic Polypeptide encoding a CAR with optional accessory module(s)
MALPVTALLLPLALLLHAARPARKRTQPTFGFTVNWKFSESTTVFTGQCFIDRNGKEVLKTMWLLRSSVNDIGDDWKATRVGINIFTRLRTQKEGGSGGSARKCSLTGKWTNDLGSNMTIGAVNSRGEFTGTYITAVTATSNEIKESPLHGTQNTINKSGGSTTVFTGQCFIDRNGKEVLKTMWLLRSSVNDIGDDWKATRVGINIFTRLRTQKEGGSGGSARKCSLTGKWTNDLGSNMTIGAVNSRGEFTGTYITAVTATSNEIKESPLHGTQNTINKRTQPTFGFTVNWKFSETRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6754 - protein, 1095 aa, Artificial Sequence
  Synthetic Polypeptide encoding a CAR with optional accessory module(s)
MALPVTALLLPLALLLHAARPDIVLTQSPASLAVSLGQRATISCRASKSVSTSGYSYLHWYQQKPGQPPKLLIYLASNLESGVPARFSGSGSGTDFTLNIHPVEEEDAATYYCQHSRELPFTFGSGTKLEIKGGGGSGGGGSGGGGSQVQLVESGGGLVQPGGSLKLSCAASGFDFSRYWMSWVRQAPGKGLEWIGEINPTSSTINFTPSLKDKVFISRDNAKNTLYLQMSKVRSEDTALYYCARGNYYRYGDAMDYWGQGTSVTVSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6755 - protein, 1093 aa, Artificial Sequence
  Synthetic Polypeptide encoding a CAR with optional accessory module(s)
MALPVTALLLPLALLLHAARPDIQMTQSPSSLSASVGDRVTITCSASQDISNYLNWYQQKPGKAPKLLIYYTSNLHSGVPSRFSGSGSGTDFTLTISSLQPEDFATYYCQQYRKLPWTFGQGTKLEIKRGGGGSGGGGSGGGGSQVQLVQSGAEVKKPGSSVKVSCKASGGTFSNYWMHWVRQAPGQGLEWMGATYRGHSDTYYNQKFKGRVTITADKSTSTAYMELSSLRSEDTAVYYCARGAIYDGYDVLDNWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6756 - protein, 1093 aa, Artificial Sequence
  Synthetic Polypeptide encoding a CAR with optional accessory module(s)
MALPVTALLLPLALLLHAARPDIVLTQSPATLSLSPGDRATISCRASESVTILGSHLIYWYQQKPGQPPRLLIQLASNVQTGVPARFSGSGSRTDFTLTISSVEPEDFAVYYCLQSRTIPRTFGQGTKLEIKRGGGGSGGGGSGGGGSQVQLVQSGPEVKKPGESVKISCKASGYTFRHYSMNWVKQAPGQGLKWMGRINTESGVPIYADDFKGRFSFTVDTSASTAYLEISSLTSEDTAVYFCSNDYLYSLDFWGQGTTLTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6757 - protein, 1094 aa, Artificial Sequence
  Synthetic Polypeptide encoding a CAR with optional accessory module(s)
MALPVTALLLPLALLLHAARPQSVLTQPPSVSGAPGQRVTISCTGSSSNIGAGFDVHWYQQLPGTAPKLLIYGNSNRPSGVPDRFSGSKSGTSASLAITGLQAEDEADYYCQSYDSSLSGYVFGTGTKVTVLGGGGGSGGGGSGGGGSQVQLVQSGAEVKKPGASVKVSCKASGYTFTDYYMHWVRQAPGQRLEWMGWINPNSGGTNYAQKFQDRITVTRDTSSNTGYMELTRLRSDDTAVYYCARSPYSGVLDKWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6758 - protein, 1092 aa, Artificial Sequence
  Synthetic Polypeptide encoding a CAR with optional accessory module(s)
MALPVTALLLPLALLLHAARPQAVLTQPPSASGTPGQRVTISCSGSSSNIGSYTVSWYQQLPGTAPKFLIYSNNQRPSGVPDRFSGSKSGTSASLAISGLQSEDEADYYCAAWDDSLNGYVFGTGTKVTVLGGGGGSGGGGSGGGGSEVQLVQSGAEVKKPGESLKISCKGSGYDFTTYWIGWVRQMPGKGLEWMGIIYPGDSDTRYSPSVRGRVTISADKSINTAYLQWSSLEASDTAMYYCARMWTFSQDGWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6759 - protein, 1103 aa, Artificial Sequence
  Synthetic Polypeptide encoding a CAR with optional accessory module(s)
MALPVTALLLPLALLLHAARPLPVLTQPPSASGTPGQRVTISCSGRSSNIGSNSVNWYRQLPGAAPKLLIYSNNQRPPGVPVRFSGSKSGTSASLAISGLQSEDEATYYCATWDDNLNVHYVFGTGTKVTVLGSRGGGGSGGGGSGGGGSLEMAQVQLVQSGAEVKKPGSSVKVSCKASGGTFSSYAISWVRQAPGQGLEWMGRIIPILGIANYAQKFQGRVTITADKSTSTAYMELSSLRSEDTAVYYCARGGYYSHDMWSEDWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6760 - protein, 1092 aa, Artificial Sequence
  Synthetic Polypeptide encoding a CAR with optional accessory module(s)
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKGGGGSGGGGSGGGGSQVQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6761 - protein, 1093 aa, Artificial Sequence
  Synthetic Polypeptide encoding a CAR with optional accessory module(s)
MALPVTALLLPLALLLHAARPDIVLTQSPATLSLSPGDRATLSCRASESVTILGSHLIYWYQQKPGQAPRLLIQLASNVQTGIPARFSGSGSRTDFTLTISSLEPEDFAVYYCLQSRTIPRTFGQGTKLEIKRGGGGSGGGGSGGGGSQVQLVQSGSELKKPGESVKISCKASGYTFTHYSMNWVRQAPGQGLEWMGRINTETGEPLYADDFKGRFVFSLDTSASTAYLQISSLKAEDTAVYYCSNDYLYSLDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6762 - protein, 1094 aa, Artificial Sequence
  Synthetic Polypeptide encoding a CAR with optional accessory module(s)
MALPVTALLLPLALLLHAARPDIVMTQSPDSLAVSLGERATINCKSSQSILYSSNQKNYLAWYQQKPGQSPKLLIYWASTRESGVPDRFSGSGSGTDFTLTISSLQAEDVAVYYCHQYISSYTFGQGTKLEIKGGGGSGGGGSGGGGSQVQLVQSGAEVKKPGASVKVSCKASGYTFASQWMHWMRQAPGQGLEWIGWINPGNVNTKYNEKFKGRATLTVDTSTNTAYMELSSLRSEDTAVYYCARSTWYRPLDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6763 - protein, 1218 aa, Artificial Sequence
  Synthetic Polypeptide encoding a CAR with optional accessory module(s)
MVRGVPFRHLLLVLQLALLPAATQGKKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASGGGGSGGGGSGGGGSIYQELTQLKAAVERLCHPCPWEWTFFQGNCYFMSNSQRNWHDSITACKEVGAQLVVIKSAEEQNFLQLQSSRSNRFTWMGLSDLNQEGTWQWVDGSPLLPSFKQYWNRGEPNNVGEEDCAEFSGNGWNDDKCNLAKFWICKKSAASCSRDEEQFLSPAPATPNPPPATRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6764 - protein, 1094 aa, Artificial Sequence
  Synthetic Polypeptide encoding a CAR with optional accessory module(s)
MALPVTALLLPLALLLHAARPDHIVLTQSPSSLSASLGDRVTISCRASQDISTYLNWYQQKPDGTVKLLIFYTSRLHAGVPSRFSGSGSGTHHSLTISNLEQEDIATYFCQQGNSLPFTFGSGTKLEIKRGGGGSGGGGSGGGGSQVQLKESGPELEKPGASVKISCKASGYSFTAYSMNWVKQNNGMSLEWIGSIDPYYGDTKYAQKFKGKATLTVDKASSTAYLQLKSLTSEDSAVYYCARRMITTGDWYFDVWGAGTTVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6765 - protein, 1094 aa, Artificial Sequence; identical to SEQ ID NO: 6764
  Synthetic Polypeptide encoding a CAR with optional accessory module(s)

SEQ ID NO: 6766 - protein, 1041 aa, Artificial Sequence
  Synthetic Polypeptide encoding a CAR with optional accessory module(s)
MALPVTALLLPLALLLHAARPGMRTEDLPKAVVFLEPQWYRVLEKDSVTLKCQGAYSPEDNSTQWFHNESLISSQASSYFIDAATVDDSGEYRCQTNLSTLSDPVQLEVHIGWLLLQAPRWVFKEEDPIHLRCHSWKNTALHKVTYLQNGKGRKYFHHNSDFYIPKATLKDSGSYFCRGLVGSKNVSSETVNITITQGLAVSTISSFFPPGYQTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6767 - protein, 1041 aa, Artificial Sequence; identical to SEQ ID NO: 6766
  Synthetic Polypeptide encoding a CAR with optional accessory module(s)

SEQ ID NO: 6768 - protein, 1094 aa, Artificial Sequence
  Synthetic Polypeptide encoding a CAR with optional accessory module(s)
MALPVTALLLPLALLLHAARPDEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGGGGSGGGGSGGGGSEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6769 - protein, 1096 aa, Artificial Sequence
  Synthetic Polypeptide encoding a CAR with optional accessory module(s)
MALPVTALLLPLALLLHAARPDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKRGGGGSGGGGSGGGGSQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6770 - protein, 1093 aa, Artificial Sequence
  Synthetic Polypeptide encoding a CAR with optional accessory module(s)
MALPVTALLLPLALLLHAARPDIVLTQSPAIITASPGEKVTMTCRASSSVNYMDWYQKKPGSSPKPWIYATSNLASGVPSRFSGSGSGTTYSMTISSLEAEDAATYYCQQWSFNPPTFGGGTKLEIKRGGGGSGGGGSGGGGSEVQLQQSGAELKKPGASVKVSCKASGYTFTSYNMHWVKQTPGQGLEWIGAIYPGNGDTSYNQKFKGKTTLTADKSSSTAYMELSSLRSEDTAVYYCARSNYYGSSYWFFDVWGTGTTVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6771 - protein, 1096 aa, Artificial Sequence
  Synthetic Polypeptide encoding a CAR with optional accessory module(s)
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSDWPLTFGGGTKVEIKGGGGSGGGGSGGGGSEVQLVQSGGGLVHPGGSLRLSCTGSGFTFSYHAMHWVRQAPGKGLEWVSIIGTGGVTYYADSVKGRFTISRDNVKNSLYLQMNSLRAEDMAVYYCARDYYGAGSFYDGLYGMDVWGQGTTVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6772 - protein, 1094 aa, Artificial Sequence
  Synthetic Polypeptide encoding a CAR with optional accessory module(s)
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGGGTKVEIKGGGGSGGGGSGGGGSAVQLVESGGGLVQPGRSLRLSCAASGFTFGDYTMHWVRQAPGKGLEWVSGISWNSGSIGYADSVKGRFTISRDNAKNSLYLQMNSLRAEDTALYYCTKDNQYGSGSTYGLGVWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6773 - protein, 1093 aa, Artificial Sequence
  Synthetic Polypeptide encoding a CAR with optional accessory module(s)
MALPVTALLLPLALLLHAARPDIQMTQSPSSLSASVGDRVTITCRASSSVSYMHWYQQKPGKAPKPLIYAPSNLASGVPSRFSGSGSGTDFTLTISSLQPEDFATYYCQQWSFNPPTFGQGTKVEIKRGGGGSGGGGSGGGGSEVQLVESGGGLVQPGGSLRLSCAASGYTFTSYNMHWVRQAPGKGLEWVGAIYPGNGDTSYNQKFKGRFTISVDKSKNTLYLQMNSLRAEDTAVYYCARVVYYSNSYWYFDVWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6774 - protein, 1091 aa, Artificial Sequence
  Synthetic Polypeptide encoding a CAR with optional accessory module(s)
MALPVTALLLPLALLLHAARPDIQLTQSPSSLSASVGDRVTMTCRASSSVSYIHWFQQKPGKAPKPWIYATSNLASGVPVRFSGSGSGTDYTFTISSLQPEDIATYYCQQWTSNPPTFGGGTKLEIKGGGGSGGGGSGGGGSQVQLQQSGAEVKKPGSSVKVSCKASGYTFTSYNMHWVKQAPGQGLEWIGAIYPGNGDTSYNQKFKGKATLTADESTNTAYMELSSLRSEDTAFYYCARSTYYGGDWYFDVWGQGTTVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6775 - protein, 1103 aa, Artificial Sequence
  Synthetic Polypeptide encoding a CAR with optional accessory module(s)
MALPVTALLLPLALLLHAARPSTVMTQSPDSLAVSLGERATINCKSSQSNSNDVAWYQQKPGQSPKVLIYFASNRYSGVPDRFSGSGYGTDFTLTISSLQAEDVAVYFCQQDYSSPLTFGAGTKLELKRADAGGGGSGGGGSGGGGSQIQLVQSGSELKKPGASVKVSCKASGYTFTNFGVNWVRQAPGKGLEWMGWINTYTGEPSYAQGFTGRFVFSLDASVSTAYLQISSLKAEDTATYFCTRRTNYYGTSYYYAMDYWGQGTTVTVSSAKTTTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6776 - protein, 1095 aa, Artificial Sequence
  Synthetic Polypeptide encoding a CAR with optional accessory module(s)
MALPVTALLLPLALLLHAARPQIVLSQSPAILSASPGEKVTMTCRASSSVSYMHWYQQKPGSSPKPWIYATSNLASGVPARFSGSGSGTSYSFTISRVEAEDAATYYCQQWTFNPPTFGGGTRLEIKRTVAAGGGGSGGGGSGGGGSQAYLQQSGAELVRPGASVKMSCKASGYTFTSYNMHWVKQTPRQGLEWIGGIYPGNGDTSYNQKFKGKATLTVGKSSSTAYMQLSSLTSEDSAVYFCARYDYNYAMDYWGQGTSVTVSSASTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6777 - protein, 1093 aa, Artificial Sequence; identical to SEQ ID NO: 6773
  Synthetic Polypeptide encoding a CAR with optional accessory module(s)

SEQ ID NO: 6778 - protein, 1092 aa, Artificial Sequence
  Synthetic Polypeptide encoding a CAR with optional accessory module(s)
MALPVTALLLPLALLLHAARPEIVLTQSPSSLSASVGDRVTITCRASSSLSFMHWYQQKPGKAPKPWIYATSNLASGVPSRFSGSGSGTDYTLTISSLQPEDFATYFCHQWSSNPLTFGGGTKVEIKGGGGSGGGGSGGGGSQVQLVQSGAEVKKPGASVKVSCKASGYTFTSYNMHWVRQAPGQRLEWIGAIYPGNGDTSYNQKFKGRVTVTRDTSANTAYMELSSLKSEDTAVYYCARSHYGSNYVDYFDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6779 - protein, 1094 aa, Artificial Sequence
  Synthetic Polypeptide encoding a CAR with optional accessory module(s)
MALPVTALLLPLALLLHAARPDEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGGGGSGGGGSGGGGSEVQLVESGGGLVQPDRSLRLSCAASGFTFHDYAMHWVRQAPGKGLEWVSTISWNSGTIGYADSVKGRFTISRDNAKNSLYLQMNSLRAEDTALYYCAKDIQYGNYYYGMDVWGQGTTVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6780 - protein, 1092 aa, Artificial Sequence
  Synthetic Polypeptide encoding a CAR with optional accessory module(s)
MALPVTALLLPLALLLHAARPEIVLTQSPGTLSLSPGERATLSCRASSSVPYIHWYQQKPGQAPRLLIYATSALASGIPDRFSGSGSGTDFTLTISRLEPEDFAVYYCQQWLSNPPTFGQGTKLELKRGGGGSGGGGSGGGGSEVQLVQSGAEVKKPGESLKLSCKGSGRTFTSYNMHWVRQMPGKGLEWMGAIYPLTGDTSYNQKSKLQVTISADKSISTAYLQWSSLKASDTAMYYCARSTYVGGDWQFDVWGKGTTVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6781 - protein, 1097 aa, Artificial Sequence
  Synthetic Polypeptide encoding a CAR with optional accessory module(s)
MALPVTALLLPLALLLHAARPDIQMTQSPSSLSASVGDRVTITCRSSQSIVHSVGNTFLEWYQQKPGKAPKLLIYKVSNRFSGVPSRFSGSGSGTDFTLTISSLQPEDFATYYCFQGSQFPYTFGQGTKVEIKRGGGGSGGGGSGGGGSEVQLVESGGGLVQPGGSLRLSCAASGYEFSRSWMNWVRQAPGKGLEWVGRIYPGDGDTNYSGKFKGRFTISADTSKNTAYLQMNSLRAEDTAVYYCARDGSSWDWYFDVWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6782 - protein, 1089 aa, Artificial Sequence
  Synthetic Polypeptide encoding a CAR with optional accessory module(s)
MALPVTALLLPLALLLHAARPDIVMTQSPSSLSASVGDRVTITCKASQSVTNDVAWYQQKPGKAPKLLIYYASNRYTGVPSRFSGSGSGTDFTLTISSLQPEDFATYYCQQDYRSPWTFGGGTKVEIKRGGGGSGGGGSGGGGSQVQLEESGGGVVRPGRSLRLSCAASGFTFSDYGVNWIRQAPGKGLEWVTIIWGDGRTDYNSALKSRFTVSRNNSNNTLSLQMNSLTTEDTAVYYCVRAPGNRAMEYWGQGVLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6783 - protein, 1095 aa, Artificial Sequence
  Synthetic Polypeptide encoding a CAR with optional accessory module(s)
MALPVTALLLPLALLLHAARPDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQIFGQGTKLEIKGGGGSGGGGSGGGGSQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6784 - protein, 1095 aa, Artificial Sequence
  Synthetic Polypeptide encoding a CAR with optional accessory module(s)
MALPVTALLLPLALLLHAARPQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSGGGGSGGGGSGGGGSDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQIFGQGTKLEIKTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6785 - protein, 1088 aa, Artificial Sequence
  Synthetic Polypeptide encoding a CAR with optional accessory module(s)
MALPVTALLLPLALLLHAARPDIQMTQSPATIENTSLSASVGDRVTITCRASQGISSWLTWYQQKPEKAPKSLIYAASSLQSGVPSRFSGSGSGTDFTLTISSLQPEDFATYYCQQYDSYPITFGQGTRLEIKGGGGSGGGGSGGGGSQVQLQQWGAGLLKPSETLSLTCAVYGGSFSAYYWSWIRQPPGKGLEWIGDINHGGGTNYNPSLKSRVTISVDTSKNQFSLKLNSVTAADTAVYYCASLTAYWGQGSLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6786 - protein, 1093 aa, Artificial Sequence
  Synthetic Polypeptide encoding a CAR with optional accessory module(s)
MALPVTALLLPLALLLHAARPDEIVLTQSPDSLAVSLGERATINCKASQSVDFDGDSYLNWYQQKPGQPPKVLIYAASTLQSGVPSRFSGSGSGTDFTLTINSLEAEDAATYYCQQSNEDPWTFGGGTKVEIKGGGGSGGGGSGGGGSQVQLVQSGAEVKKPGASVKVSCKVSGYTFTDYYITWVRQAPGQALEWMGWIYPGSGNTKYSQKFQGRFVFSVDTSASTAYLQLSSLKAEDTAVYYCANYGNYWFAYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6787 - protein, 1090 aa, Artificial Sequence
  Synthetic Polypeptide encoding a CAR with optional accessory module(s)
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKGGGGSGGGGSGGGGSEVQLVQSGGGLVHPGGSLRLSCAGSGFAFSSSTMHWIRQAPGKGLEWISLIGSGGGIYYGDSVKGRFTISRDNAKNSLYLQMNSLRAEDMAVYYCVRGYFDWVDYFDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6788 - protein, 1100 aa, Artificial Sequence
  Synthetic Polypeptide encoding a CAR with optional accessory module(s)
MALPVTALLLPLALLLHAARPDDIVMTQSPDSLTVSLGERTTINCKSSQSVLDSSKNKNSLAWYQQKPGQPPKLLLSWASTRESGIPDRFSGSGSGTDFTLTIDSLQPEDSATYYCQQSAHFPITFGQGTRLEIKGGGGSGGGGSGGGGSQVQLVQSGAEVKKPGASVKVSCKASGYTFTNYGMNWVKQAPGQGLKWMGWINTYTGEPTYADDFKGRVTMTSDTSTSTAYLELHNLRSDDTAVYYCARWSWSDGYYVYFDYWGQGTTVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6789 - protein, 1096 aa, Artificial Sequence
  Synthetic Polypeptide encoding a CAR with optional accessory module(s)
MALPVTALLLPLALLLHAARPDEIVLTQSPGSLAVSPGERVTMSCKSSQSVFFSSSQKNYLAWYQQIPGQSPRLLIYWASTRESGVPDRFTGSGSGTDFTLTISSVQPEDLAIYYCHQYLSSRTFGQGTKLEIKRGGGGSGGGGSGGGGSQVQLQQPGAEVVKPGASVKMSCKASGYTFTSYYIHWIKQTPGQGLEWVGVIYPGNDDISYNQKFQGKATLTADKSSTTAYMQLSSLTSEDSAVYYCAREVRLRYFDVWGQGTTVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6790 - protein, 1122 aa, Artificial Sequence
  Synthetic Polypeptide encoding a CAR with optional accessory module(s)
MALPVTALLLPLALLLHAARPYINIYNAEPANPSEKNSPTQYAYGSGEFDIQLTQSPSSLSASVGDRVTITCRASQGISSVLAWYQQKPGKAPKLLIYDASSLESGVPSRFSGSGSGTDFTLTISSLQPEDFATYYCQQFNSSITFGQGTKLEIKRTVAAGGGGSGGGGSGGGGSQVQLVQSGAEVKKPGSSVKVSCKASGGTFSDYAISWVRQAPGQGLEWMGRIIPILGVANYAQKFQGRVTITADKSTRTAYMELSSLRSEDTAVYYCARNWADAFDIWGQGTMVTVSSASTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6791 - protein, 1121 aa, Artificial Sequence
  Synthetic Polypeptide encoding a CAR with optional accessory module(s)
MALPVTALLLPLALLLHAARPYINIYNAEPANPSEKNSPTQYAYGSGEFDIVMTQSPSSLSASLGGKVTITCKASQDINKYIAWYQHKPGKGPRLLIHYTSTLQPGIPSRFSGSGSGRDYSFSISNLEPEDIATYYCLQYDNLLTFGAGTKLELKRGGGGSGGGGSGGGGSEVKLQQSGPELVKPGTSVKVSCKASGYSFTDYNMYWVKQSHGKSLEWIGYIDPYKGGTIYNQKFKGKATLTVDKSSSTAFMHLNSLTSEDSAVYYCAREMITAYYFDYWGQGSSVTVSSLERTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6792 - protein, 1137 aa, Artificial Sequence
  Synthetic Polypeptide encoding a CAR with optional accessory module(s)
MALPVTALLLPLALLLHAARPDIQMTQSPSSLSASVGDRVTINCKASQDINSYLSWFQQKPGKAPKTLIYRANRLVDGVPSRFSGSGSGQDYTLTISSLQPEDFATYYCLQYDEFPLTFGGGTKVEIKGGGGSGGGGSGGGGSQVQLVQSGAEVKKPGASVKVSCKASGYTFTNYDINWVRQAPGQGLEWIGWIYPGDGSTKYNEKFKAKATLTADTSTSTAYMELRSLRSDDTAVYYCASGYEDAMDYWGQGTTVTVSSAKPTTTPAPRPPTPAPTIASQPLSLRPEACRPAAGGAVHTRGLDFACDITRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6793 - protein, 1093 aa, Artificial Sequence
  Synthetic Polypeptide encoding a CAR with optional accessory module(s)
MALPVTALLLPLALLLHAARPEIVLTQSPLSLPVTPGEPASISCRSSQSLLHSNGYNYLDWYLQKPGQSPQLLIYLGVNSVSGVPDRFSGSGSGTDFTLKISRVEAEDVGVYYCMQALQTPWTFGQGTKVEIKGGGGSGGGGSGGGGSQVQLVQSGAEVKKPGSSVKVSCKASGGIFSNHAISWVRQAPGQGLEWMGGIIPIFGTANYAQKFQGRVTITADESTSTAFMELSSLRSEDTAVYYCAREWADVFDIWGQGTMVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6794 - protein, 1092 aa, Artificial Sequence
  Synthetic Polypeptide encoding a CAR with optional accessory module(s)
MALPVTALLLPLALLLHAARPDIQMTQSPASLTVSLGQRATISCRASESVDSYGNSYLHWYQQKPGQPPQLLIYLASNLESGVPARFSGSGSRTDFTLTIDPVEADDAATYYCQQNNEDPWTFGGGTKVEIKGGGGSGGGGSGGGGSEVQLQQSGAELVKPGASVKMSCKAFGYTFTTFPIEWMKQSHGKSLEWIGNFHPYNDQTKYNEEFKGRAKLTIDRSSSTVYLELGRLTSDDSAVYYCARGYYYAFDFWGQGTTLTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6795 - protein, 1089 aa, Artificial Sequence
  Synthetic Polypeptide encoding a CAR with optional accessory module(s)
MALPVTALLLPLALLLHAARPDIQMTQSPSSLSASVGDRVTITCRASQGIRNDLGWYQQKPGKAPKRLIYAASSLQSGVPSRFSGSGSGTEFTLTISSLQPEDFATYYCLQHNSYPWTFGQGTKLEIKGGGGSGGGGSGGGGSEVQLVESGGALIQPGGSLRLSCVASGFTISGNYMSWVRQAPGKGLEWVSLIYSGDSTYYADSVKGRFTISRDISKNTVYLQMNSLRVEDTAVYYCVRDGYYVSDMVVWGKGTTVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6796 - protein, 1099 aa, Artificial Sequence
  Synthetic Polypeptide encoding a CAR with optional accessory module(s)
MALPVTALLLPLALLLHAARPDVLLTQSPLSLPVTLGQPASISCRSSQTIVHSNGNTYLEWFQQRPGQSPRLLIYQVSNRFSGVPDRFSGSGSGTDFTLKISRVEAEDVGVYYCFQGSHVPRTFGGGTKVEIKRGGGGSGGGGSGGGGSQIQLVQSGSELKKPGASVKVSCKASGYTFTNYGMNWVRQAPGQGLKWMGWINTNTGEPKYAEEFKGRFALSLDTSVSTAYLQINSLKAEDTAVYFCARGYGNYARGAWLAYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6797 - protein, 1086 aa, Artificial Sequence
  Synthetic Polypeptide encoding a CAR with optional accessory module(s)
MALPVTALLLPLALLLHAARPDEIVLTQSPATLSLSPGERATLSCSASSSINYIYWLQQKPGQAPRILIYLTSNLASGVPARFSGSGSGTDFTLTISSLEPEDFAVYYCLQWSSNPLTFGGGTKVEIKGGGGSGGGGSGGGGSFEVQLVESGGGLVKPGGSLRLSCAASGFTFSSYDMSWVRQAPGKGLEWVSTISSGGSYTYYLDSIKGRFTISRDNAKNSLYLQMNSLRAEDTAVYYCARQGLDYWGRGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6798 - protein, 1094 aa, Artificial Sequence
  Synthetic Polypeptide encoding a CAR with optional accessory module(s)
MALPVTALLLPLALLLHAARPDIVMTQSPDSLAVSLGERATINCRASKSVSTSGYSFMHWYQQKPGQPPKLLIYLASNLESGVPDRFSGSGSGTDFTLTISSLQAEDVAVYYCQHSREVPWTFGQGTKVEIKRGGGGSGGGGSGGGGSQVQLVQSGAEVKKPGASVKVSCKASGYTFTNYGMNWVRQAPGQGLEWMGWINTYTGEPTYADAFKGRFAFSLDTSTSTAYLQINSLRSDDTAVYYCARDYGDYGMDYWGQGTTVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6799 - protein, 1090 aa, Artificial Sequence
  Synthetic Polypeptide encoding a CAR with optional accessory module(s)
MALPVTALLLPLALLLHAARPDIVMTQTPLTLSVTIGQPASISCKSSQSLLDSDGKTYLNWLLQRPGQSPERLIYLVSKLDSGVPDRFTGSGSGTDFTLKISRVEAEDLGVYCCWQGTHFPYTFGGGTKVEIKGGGGGSGGGGSGGGGSQVQLQQPGAELVRPGASVKLSCKASGYTFTSYWMNWVKQRPGQGLEWIGMIDPSDSETHYNHIFKDKATLTVDKSSSTAYLQLSSLTSEDSAVYYCARNLYLWGQGTSVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6800 - protein, 1094 aa, Artificial Sequence
  Synthetic Polypeptide encoding a CAR with optional accessory module(s)
MALPVTALLLPLALLLHAARPDDIQLTQSPSSLSASVGDRVTITCKASQSVDYEGDSFLNWYQQKPGKAPKLLIYAASNLESGVPSRFSGSGSGTDFTLTISSLQPEDFATYYCQQSNEDPLTFGQGTKVEIKRGGGGSGGGGSGGGGSEVQLVESGGGLVQPGGSLRLSCAASGYTFSSYWIEWVRQAPGKGLEWIGEILPGGGDTNYNEIFKGRATFSADTSKNTAYLQMNSLRAEDTAVYYCTRRVPIRLDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6801 - protein, 1090 aa, Artificial Sequence
  Synthetic Polypeptide encoding a CAR with optional accessory module(s)
MALPVTALLLPLALLLHAARPDIVMTQTPLSLSVTPGQPASISCKSSQSLLDGDGKTYLNWLLQKPGQSPQRLIYLVSKLDSGVPDRFSGSGSGTDFTLKISRVEAEDVGVYYCWQGTHFPRTFGQGTKLEIKGGGGSGGGGSGGGGSQVQLVQSGAEVKKPGASVKVSCKASGYTFKDTYIHWVRQAPGQGLEWMGRIDPANGNTKYDPKFQGRVTMTRDTSISTAYMELSRLRSDDTAVYYCARRGGVDWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6802 - protein, 1098 aa, Artificial Sequence
  Synthetic Polypeptide encoding a CAR with optional accessory module(s)
MALPVTALLLPLALLLHAARPDIVMTQSPDSLAVSLGERATINCESSQSLLNSGNQKNYLTWYQQKPGQPPKPLIYWASTRESGVPDRFSGSGSGTDFTLTISSLQAEDVAVYYCQNDYSYPYTFGQGTKLEIKRGGGGSGGGGSGGGGSEVQLVQSGAEVKKPGESLKISCKGSGYSFTDYYMKWARQMPGKGLEWMGDIIPSNGATFYNQKFKGQVTISADKSISTTYLQWSSLKASDTAMYYCARSHLLRASWFAYWGQGTMVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6803 - protein, 1093 aa, Artificial Sequence
  Synthetic Polypeptide encoding a CAR with optional accessory module(s)
MALPVTALLLPLALLLHAARPDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKGGGGSGGGGSGGGGSQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6804 - protein, 1097 aa, Artificial Sequence
  Synthetic Polypeptide encoding a CAR with optional accessory module(s)
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKGGGGSGGGGSGGGGSEVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6805 - protein, 1097 aa, Artificial Sequence
  Synthetic Polypeptide encoding a CAR with optional accessory module(s)
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKGGGGSGGGGSGGGGSQVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6806 - protein, 1091 aa, Artificial Sequence
  Synthetic Polypeptide encoding a CAR with optional accessory module(s)
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQDYGFPWTFGQGTKVEIKRGGGGSGGGGSGGGGSEVQLVQSGAEVKKPGESLKISCKGSGYSFTSYWISWVRQMPGKGLEWMGIIDPSDSDTRYSPSFQGQVTISADKSISTAYLQWSSLKASDTAMYYCARGDGSTDLDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6807 - protein, 1093 aa, Artificial Sequence
  Synthetic Polypeptide encoding a CAR with optional accessory module(s)
MALPVTALLLPLALLLHAARPQFVLTQPPSVSTNPGSTVKLSCKRNTGNIGSNYVNWYQQKPGQSPTTMIYRDDKRPDGVPDRFSGSIDRSSNSALLTINNVQTEDEADYFCQSYSSGINIIFGGGTKLTVLGGGGSGGGGSGGGGSQVQLQESGPGLVKPSETLSLTCTVSGFSLTTYDVHWVRQPPGKGLEWMGRIQNAGITDYNSALKSRLIISRDTSKSQVFLKMNSVTTADTAMYFCAKTGSYFYAFDHWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6808 - protein, 1090 aa, Artificial Sequence
  Synthetic Polypeptide encoding a CAR with optional accessory module(s)
MALPVTALLLPLALLLHAARPDIQMTQSPASLSASLGETVTIECRPSEDIHSNVAWYQQKPGNSPQLLIYDASNLADGVPSRFSGSGSGTQYSLKINSLQSEDVASYFCHQYNIYPYTFGSGTKLELKGGGGSGGGGSGGGGSQVQLQESGPTLVKPGDSVKMSCKASGYTFTDYIIHWVKQSHGKSLEWIGYINPYSDGTNYNEKFKSKATLTVDKSTSTAYMEFSRLTSEDSAIYFCALNYGSYYAMDAWGQGTSVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6809 - protein, 1091 aa, Artificial Sequence
  Synthetic Polypeptide encoding a CAR with optional accessory module(s)
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGQGTKVEIKRGGGGSGGGGSGGGGSEVQLLESGGGLVQPGGSLRLSCAASGFTFSGYWMHWVRQAPGKGLEWVSAIRSDGSSKYYADSVKGRFTISRDNSKNTLYLQMNSLRAEDTAVYYCAKDGVIEDTFDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6810 - protein, 1087 aa, Artificial Sequence
  Synthetic Polypeptide encoding a CAR with optional accessory module(s)
MALPVTALLLPLALLLHAARPDVQITQSPSYLAASPGETITINCRASKSISKDLAWYQEKPGKTNKLLIYSGSTLQSGIPSRFSGSGSGTDFTLTISSLEPEDFAMYYCQQHNKYPYTFGGGTKLEIKRGGGGSGGGGSGGGGSQVQLQQPGAELVRPGASVKLSCKASGYTFTSYWMNWVKQRPDQGLEWIGRIDPYDSETHYNQKFKDKAILTVDKSSSTAYMQLSSLTSEDSAVYYCARGNWDDYWGQGTTLTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6811 - protein, 1118 aa, Artificial Sequence
  Synthetic Polypeptide encoding a CAR with optional accessory module(s)
MALPVTALLLPLALLLHAARPYINIYNAEPANPSEKNSPTQYAYGSGEFDIQMTQSPASLSASLGETVTIECRTSKDIYSNLAWFQQEPGNSPQLLIYDASNLADGVPSRFSGSGSGTQYSLQINNLQSEDVASYFCHQYNNYPYTFGTGTKLELKGGGGSGGGGSGGGGSQVQLQESGPTLVNPGDSVKMSCKASGYTFTDHIIHWVKQSHGKSLEWIGYINPYSGGANYNGKFKSKATLTIDKSSSTAYMEFSRLTSGDSAIYYCALNYGSYYAMDAWGQGTSVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6812 - protein, 1089 aa, Artificial Sequence
  Synthetic Polypeptide encoding a CAR with optional accessory module(s)
MALPVTALLLPLALLLHAARPEIVLTQSPTSMTASPGEQVTITCRASSSINYMHWYQQKPGASPRPWIYETSKLASGVPDRFSGSASGTSYSLTINNMEAEDAATYYCQQWNYPSWTFGGGTKLELKGGGGSGGGGSGGGGSEVQLVESGGGLVQPGRSLKLSCAASGFTFSDYNMAWVRQAPKKGLEWVATILYDGGRTYYRGSVKGRFTISRDNAKSTLYLRMDSLRSEDTATYYCATHSRGTDYFDYWGQGVMVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6813 - protein, 1098 aa, Artificial Sequence
  Synthetic Polypeptide encoding a CAR with optional accessory module(s)
MALPVTALLLPLALLLHAARPDIVMTQSPSSLAVSEGETVTINCKSSQSFLSSGDGKNYVAWYQYKPGQSPKLLIYWASTRQSGVPDRFIGSGSGTDFTLTISTVQAEDLAIYYCQQYYDTPLTFGSGTKLEIKGGGGSGGGGSGGGGSEVKLQESGPSLVQSSQTLSLTCTVSGFSLTSYHIHWVRQTPGKGLEWMGVMWSDGDTSYNSALKSRLSISRDTSQSQVFLKMNSLQTEDTATYYCARGYYSSYLYLWFAYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6814 - protein, 1102 aa, Artificial Sequence
  Synthetic Polypeptide encoding a CAR with optional accessory module(s)
MALPVTALLLPLALLLHAARPDVLMTQTPVSLPVSLGGQVSISCRSSQSLVHSDGDTYLHWYLQKPGQSPQLLIYRVSNRFSGVPDRFSGSGSGTDFTLKISRVEPEDLGLYYCLQTTHFPPWTFGGGTKLEMKGGGGSGGGGSGGGGSQVQLQQSGPELRRPGSSVRLSCKASGYRIKDFLIHWIKNRPEHGLEWIGWIDPEDGETKYAQKFQTKATLTADTSSNTAYMQLSSLTSEDTATYFCARWGDVYYGLMRGHVMDAWGQGTSVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6815 - protein, 1093 aa, Artificial Sequence
  Synthetic Polypeptide encoding a CAR with optional accessory module(s)
MALPVTALLLPLALLLHAARPDIQMTQSTSSLSASLGDRVTISCSASQGINNYLNWYQQKPDGTVELLIYYTSTLQSGVPSRFSGSGSGTDYSLTISNLEPEDIGTYYCQQYSKLPRTFGGGTKLEIKGGGGSGGGGSGGGGSQVQLQQSGSELMMPGASVKISCKATGYTFSNYWIEWVKQRPGHGLEWIGEILPGTGRTIYNEKFKGKATFTADISSNTVQMQLSSLTSEDSAVYYCARRDYYGNFYYAMDYWGQGTSVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6816 - protein, 1088 aa, Artificial Sequence
  Synthetic Polypeptide encoding a CAR with optional accessory module(s)
MALPVTALLLPLALLLHAARPDIQMTQSPASLSVSVGETVTITCRASENIYSNLAWYQQKQGKSPQLLVYAATNLADGVPSRFSGSGSGTQYSLKINSLQSEDFGSYYCQHFWGTWTFGGGTTLEIKGGGGSGGGGSGGGGSEVQLQQSGPELVKPGASVKMSCKASGYTFTDYYMKWMKQSHGKSLEWIGDINPNNGGTTYNQKFKGKATLTVDKSSSTAYMQLNSLTSEDSAVYYCARDYGYGYFDYWGQGTTLTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6817 - protein, 1091 aa, Artificial Sequence
  Synthetic Polypeptide encoding a CAR with optional accessory module(s)
MALPVTALLLPLALLLHAARPEIVLTQSPGTLSLSPGERATLSCRASQSVGGYLAWYQQKPGQAPRLLIYDASNRATGIPARFSGSGSGTDFTLTISSLEPEDFAVYYCQQRNNWPPMYTFGQGTKLEIKRGGGGSGGGGSGGGGSQVQLVQSGAEVKKPGSSVKVSCKASGGTFSSYAISWVRQAPGQGLEWMGGIIPILGTANYAQKFQGRVTITADESTSTAYMELSSLRSEDTAVYYCARWGGGAFDIWGQGTMVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6818 - protein, 1086 aa, Artificial Sequence
  Synthetic Polypeptide encoding a CAR with optional accessory module(s)
MALPVTALLLPLALLLHAARPQIVLTQSPALMSASPGEKVTMTCSASSSVRYMYWYQQKPRSSPKPWIHLTSNLASGVPARFSGSGSGTSYSLTISSMEAEDAATYYCQQWSSHPFTFGSGTKLEIKGGGGSGGGGSGGGGSDVQLQESGPGLVKPSQSLSLTCTVTGFSITSDYSWNWIRQFPGNKLEWMGYISYSGHTSYNPSLESRISITRDTSKNQFFLQLNSVTTEDTATYYCTRGNWDVVYWGQGTLVTVSATRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6819 - protein, 1096 aa, Artificial Sequence
  Synthetic Polypeptide encoding a CAR with optional accessory module(s)
MALPVTALLLPLALLLHAARPDVVMTQSPLSLPVTLGQPASISCRSSQSIVHSDGNTYLEWYQQRPGQSPRRLIYKVSNRFSGVPDRFSGSGSGTDFTLKISRVEAEDVGVYYCFQGSHAPWTFGGGTKVEIKGGGGSGGGGSGGGGSEVQLVESGGGLVQPGGSLRLSCAASGFTFSSYGMHWVRQAPGKGLEWVAYITTRSSTIYYADSVKGRFTISRDNAKNSLYLQMNSLRAEDTAVYYCTREPLTGYYAMDYWGQGTSVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6820 - protein, 1088 aa, Artificial Sequence
  Synthetic Polypeptide encoding a CAR with optional accessory module(s)
MALPVTALLLPLALLLHAARPDIQMTQSPSSLSASVGDRVTITCRASQSISLWLNWYQQKPGKAPKLLIYAASTLQSGVPSRFSGSGSGTDFTLTISSLQPEDFATYYCQQYYTSPYTFGQGTKVEIKRGGGGSGGGGSGGGGSQVQLLESGGGLVQPGGSLRLSCAASGFTFSSYAMSWVRQAPGKGLEWVSVIRSSGSSTYYADSVKGRFTISRDNSKNTLYLQMNSLRAEDTAVYYCARGGGYFDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6821 - protein, 1091 aa, Artificial Sequence
  Synthetic Polypeptide encoding a CAR with optional accessory module(s)
MALPVTALLLPLALLLHAARPDIQMTQSPSSLSASVGDRVTITCRASQSISSYLNWYQQKPGKAPKLLIYAVSTLQSGVPSRFSGSGSGTDFTLTISSLQPEDFATYYCQQSGTFPPTTFGQGTKVEIKRGGGGSGGGGSGGGGSQVQLLESGGGLVQPGGSLRLSCAASGFTFSSHGMHWVRQAPGKGLEWVSVISGSGSNTGYADSVKGRFTISRDNSKNTLYLQMNSLRAEDTAVYYCARQWGSYAFDSWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6822 - protein, 1101 aa, Artificial Sequence
  Synthetic Polypeptide encoding a CAR with optional accessory module(s)
MALPVTALLLPLALLLHAARPDIVMSQSPSSLAVSVGEKVTMSCKSSQSLLHSSNQKNYLAWYQQKPGQSPKVLIYWASTRESGVPDRFTGSGSGTDFTLTITSVKSEDLAVYYCQQYYSYPWTFGGGTRLEIKRGGGGSGGGGSGGGGSEVQLQQSVAELVKPGASVKMSCKVSGYTLTDHTIHWMKQRPEQGLEWIGYIYPRDGITGYNEKFKGKATLTADTSSSTAYMQLNSLTSEDSAVYFCARWGYSYRNYAYYYDYWGQGTTLTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6823 - protein, 1098 aa, Artificial Sequence
  Synthetic Polypeptide encoding a CAR with optional accessory module(s)
MALPVTALLLPLALLLHAARPEIVLTQSPGTLSLSPGERATLSCRASQSVSSSYLAWYQQKPGQAPRLLIYGTSSRATGIPDRFSGSGSGTDFTLTISRLEPEDFAVYYCQQYGSSPFTFGGGTKVEIKRGGGGSGGGGSGGGGSQVQLQESGPGLAKPSETLSLTCTVSGDSITSYYWSWIRQPPGKGLEWIGYIYYSGSTNYNPSLKSRVTISVDTSKNQFSLKLSSVTAADTAVYYCARDQRRIAAAGTHFYGMDVWGQGTTVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6824 - protein, 1090 aa, Artificial Sequence
  Synthetic Polypeptide encoding a CAR with optional accessory module(s)
MALPVTALLLPLALLLHAARPDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKGGGGSGGGGSGGGGSQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSATRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6825 - protein, 1083 aa, Artificial Sequence
  Synthetic Polypeptide encoding a CAR with optional accessory module(s)
MALPVTALLLPLALLLHAARPMTQSPKFLLVSAGDRVTLTCKASQSVNNDVYWYQQEPGQSPKLLIYWASTRESGVPDRFTGSGSGTDFTLTISSVQAEDLAVYYCKQSYNLYTFGGGTKLEIKRGGGGSGGGGSGGGGSESGRGLVQPGGSRKLSCAASGFTFSTSGMHWVRQAPEKGLEWVAYISSGSTTIYHADTVKGRFTISRDNPKNTLFLQMTSLRSEDTAMYYCCARSGQFGNYFDYWGQGTTLTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6826 - protein, 1088 aa, Artificial Sequence
  Synthetic Polypeptide encoding a CAR with optional accessory module(s)
MALPVTALLLPLALLLHAARPQSPSSLAVSAGEKVTMSCKSSQSLLNSRTRKNYLAWYQQKPGQSPKLLIYWASTRESGVPDRFTGSGSGTDFTLTISSVQAEDLAVYYCKQSNLYTFGGGTKLEIKGGGGSGGGGSGGGGSQVQLEESGPELVKPGASVKLSCKASGYTFTEYIIHWVKQRSGQGLEWIGWFYPGSGSIKYNEKFKDKATLTADKSSSTVYMELSGLTSEDSAVYFCARHDGYSYFDYWGQGTTLTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6827 - protein, 1100 aa, Artificial Sequence
  Synthetic Polypeptide encoding a CAR with optional accessory module(s)
MEMFQGLLLLLLLSMGGTWASREMLRPRCRPINATLAVEKEGCPVCITVNTTICAGYCPTMTRVLQGVLPALPQVVCNYRDVRFESIRLPGCPRGVNPVVSYAVALSCQCALCRRSTTDCGGPKDHPLTCDDPRFQASSSSKAPPPSLPSPSRLPGPSDTPILPQGGGGSGGGGSGGGGSAPDVQDCPECTLQENPFFSQPGAPILQCMGCCFSRAYPTPLRSKKTMLVQKNVTSESTCCVAKSYNRVTVMGGFKVENHTACHCSTCYYHKSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6828 - protein, 1091 aa, Artificial Sequence
  Synthetic Polypeptide encoding a CAR with optional accessory module(s)
MALPVTALLLPLALLLHAARPDIQMTQSPSSLSASLGERVSLTCRATQELSGYLSWLQQKPDGTIKRLIYAASTLDSGVPKRFSGNRSGSDYSLTISSLESEDFADYYCLQYAIYPYTFGGGTKLEIKGGGGSGGGGSGGGGSEVQLQQSGPELVKPGASVKMSCKASGYTFTSYFIHWVKQKPGQGLEWIGFINPYNDGSKYNEKFKGKATLTSDKSSSTAYMELSSLTSEDSAVYYCTRDDGYYGYAMDYWGQGTSVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6829 - protein, 1096 aa, Artificial Sequence
  Synthetic Polypeptide encoding a CAR with optional accessory module(s)
MALPVTALLLPLALLLHAARPDTIVLTQSPASLAVSLGQRATISCRASESVDSYGNSFMHWYQQKPGQPPKLLIYLASNLESGVPARFSGSGSRTDFTLTIDPVEADDAATYYCQQNNYDPWTFGGGTKLEIKGGGGSGGGGSGGGGSEVQLQQSGPELVKPGASVKMSCKASGYTFTSYVMHWVKQKPGQGLEWIGYINPYNDGTKYNEKFKGKATLTSDTSSSTAYMELNSLTSEDSAVYFCARPIYFDNDYFDYWGQGTTLKVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6830 - protein, 1091 aa, Artificial Sequence
  Synthetic Polypeptide encoding a CAR with optional accessory module(s)
MALPVTALLLPLALLLHAARPDIQMTQSPSSLSASVGDRVTITCKASQDVSTAVAWFQQKPGKAPKLLIYSPSYRYTGVPSRFSGSGSGTDFTLTISSLQPEDFTYYCQQLYSTPYTFGQGTKVEIKGGGGSGGGGSGGGGSEVQLVQSGAEVKKPGASVKVSCKASGYTFTDYYLDVVVRQAPGQGLEWIGRVNPYNGGTIYNQKFKGRVTLTRDTSTSTAYLELSSLRSEDTAVYYCARDHYRYDPLLDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6831 - protein, 1097 aa, Artificial Sequence
  Synthetic Polypeptide encoding a CAR with optional accessory module(s)
MALPVTALLLPLALLLHAARPDIQMTQSPSSLSASVGDRVTITCRASQSVSTSSYNYMHWYQQKPGKPPKLLIKYASNLESGVPSRFSGSGSGTDFTLTISSLQPEDFATYYCQHSWEIPLTFGQGTKVEIKGGGGSGGGGSGGGGSEVQLVQSGAEVKKPGASVKVSCKASGYSFTDYYMHWVRQAPGQGLEWIGRINPYNGAAFYSQNFKDRVTLTVDTSTSTAYLELSSLRSEDTAVYYCAIERGADLEGYAMDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6832 - protein, 1095 aa, Artificial Sequence
  Synthetic Polypeptide encoding a CAR with optional accessory module(s)
MALPVTALLLPLALLLHAARPEIVLTQSPATLSASPGERVTLTCRASSNVISSYVHWYQQKPGSSPRLFLYSTSNLASGVPSRFSGSGSGTDFTFTISSLEAEDAATYYCQQYSGYPLTFGQGTRLEIKGGGGSGGGGSGGGGSQVQLQESGPGLVKPSETLSLTCAVSGYSITSAYYWNWIRQPPGKGLEWIGYISYDGRNNYNPSLKNRITINPDTSKNQFSLQLNSVTPEDTAVYYCAREGDYDVGNYYAMDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6833 - protein, 1095 aa, Artificial Sequence
  Synthetic Polypeptide encoding a CAR with optional accessory module(s)
MALPVTALLLPLALLLHAARPEIVLTQSPATLSLSPGERATLSCRASSNVISSYVHWYQQKPGQAPRLLIYSTSNLASGIPARFSGSGSGTDFTLTISSLEPEDFAVYYCQQYSGYPLTFGQGTRLEIKGGGGSGGGGSGGGGSEVQLVESGGGLVQPGRSLRLSCAASGYSITSAYYWNWVRQAPGKGLEWVSYISYDGRNNYNPSLKNRFTISRDNAKKSLYLQMNSLRAEDTALYYCAKEGDYDVGNYYAMDYWGQGTTVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6834 - protein, 1107 aa, Artificial Sequence
  Synthetic Polypeptide encoding a CAR with optional accessory module(s)
MALPVTALLLPLALLLHAARPDLNFMLTQPHSVSGSPGKTVTISCTRSTGSITSNYVHWYQQRPGSSPTTVICEDNERPSGVPDRFSGSIDISSNSASLTISGLKTEDEADYYCQSYDDSNHISVFGTGTKVTVLGQPKANPGGGGSGGGGSGGGGSQVQLQESGPGLVKPSETLSLTCTVSGGSISSSNYYWGWIRQPPGKGLEWIGAIYYSGSTYYNPSLKSRVAISVDTSKNQFSLKLSSVTAADTAVYYCARRIGVAGQWYFDLWGRGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6835 - protein, 1093 aa, Artificial Sequence
  Synthetic Polypeptide encoding a CAR with optional accessory module(s)
MALPVTALLLPLALLLHAARPDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKGGGGSGGGGSGGGGSQIQLVQSGPDLKKPGETVKISCKASGYTFTNTGMNWVKQAPGKGLKWMGWINTYTGEPTYADDFKGRFTFSLETSASTAYLQINNLKNEDTATYFCTRWGYGSSLYYAMDYWGQGTSVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6836 - protein, 1090 aa, Artificial Sequence
  Synthetic Polypeptide encoding a CAR with optional accessory module(s)
MALPVTALLLPLALLLHAARPDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKGGGGSGGGGSGGGGSEVQLVESGGGLVQPGGSLRLSCAASGFDFSRYWMSWVRQAPGKGLEWIGEINPDSSTINYAPSLKDKFIISRDNAKNSLYLQMNSLRAEDTAVYYCARPDGNYWYFDVWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6837 - protein, 1091 aa, Artificial Sequence
  Synthetic Polypeptide encoding a CAR with optional accessory module(s)
MALPVTALLLPLALLLHAARPDIVMTQSQKSMSTSVGDRVSITCKASQDVITGVAWYQQKPGQSPKLLIYSASYRYTGVPDRFTGSGSGTDFTFTISNVQAEDLAVYYCQQHYSTPLTFGAGTKLELKGGGGSGGGGSGGGGSQVQLQQPGAELVRPGASVKLSCKASGYSFTTYWMNWVKQRPGQGLEWIGMIHPSDSETRLNQKFKDKATLTVDKSSSTAYMQLSSPTSEDSAVYYCARSTMIATRAMDYWGQGTSVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6838 - protein, 1093 aa, Artificial Sequence
  Synthetic Polypeptide encoding a CAR with optional accessory module(s)
MALPVTALLLPLALLLHAARPDIQMTQSPSSLSASVGDRVTITCKASQDVSTAVAWYQQKPGKAPKLLIYSASYRYTGVPDRFTGSGSGTDFTLTISSLQPEDFATYYCQQHYSTPPYTFGGGTKVEIKRGGGGSGGGGSGGGGSQVQLVQSGAEVKKPGASVKVSCKASGYAFSSSWMNWVRQAPGQGLEWIGRIYPGDGDTKYNGKFKGKATLTADKSTSTAYMELSSLRSEDTAVYYCARSTMIATGAMDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6839 - protein, 1094 aa, Artificial Sequence
  Synthetic Polypeptide encoding a CAR with optional accessory module(s)
MALPVTALLLPLALLLHAARPDVVMTQTPLSLSVTPGQPASISCRSSQSLVHNNGNTYLHWYLQKPGQSPQLLIYKVSNRFSGVPDRFSGSGSGTDFTLKISRVEAEDVGVYFCSQSTHVPPYTFGGGTKVEIKGGGGSGGGGSGGGGSEVQLVESGGGLVQPGGSLRLSCAASGFTFSDYYMAWVRQAPGKGLEWVAEINYDGSSTYYVDSVKGRFTISRDNAKNSLYLQMNSLRAEDTAVYYCARDRGFYFDYWGQGTTVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6840 - protein, 1094 aa, Artificial Sequence
  Synthetic Polypeptide encoding a CAR with optional accessory module(s)
MALPVTALLLPLALLLHAARPDVVMTQTPLSLSVTPGQPASISCRSSQSLVHSNGLTYLHWYLQKPGQSPQLLIYKVSNRFSGVPDRFSGSGSGTDFTLKISRVEAEDVGVYFCSQSTHVPPFTFGGGTKVEIKGGGGSGGGGSGGGGSEVQLVESGGGLVQPGGSLRLSCAASGFTFSDYYMAWVRQAPGKGLEWVASINYDGESTYYVDSVKGRFTISRDNAKNSLYLQMNSLRAEDTAVYYCARDRGYYFDYWGQGTTVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6841 - protein, 1094 aa, Artificial Sequence
  Synthetic Polypeptide encoding a CAR with optional accessory module(s)
MALPVTALLLPLALLLHAARPDVVMTQSPLSLPVTPGEPASISCRSSQSLVHSNGNTYLHWYLQKPGQSPQLLIYKVSNRFSGVPDRFSGSGSGTDFTLKISRVEAEDVGVYFCSQSTHVPPFTFGGGTKVEIKGGGGSGGGGSGGGGSEVQLVESGGGLVQPGGSLRLSCAASGFTFSDYYMAWVRQAPGKGLEWVADINYDGGSTYYLDSLKSRFTISRDNAKNSLYLQMNSLRAEDTAVYYCARDRGYYFDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6842 - protein, 1092 aa, Artificial Sequence
  Synthetic Polypeptide encoding a CAR with optional accessory module(s)
MALPVTALLLPLALLLHAARPDIQMTQSSSYLSVSLGGRVTITCKASDHINNWLAWYQQKPGNAPRLLISGATSLETGVPSRFSGSGSGKDYTLSITSLQTEDVATYYCQQYWSTPWTFGGGTKLEIKGGGGSGGGGSGGGGSQVQLQQSGAELARPGASVKLSCKASGYTFTSYWMQWVKQRPGQGLEWIGAIYPGDGDTRYTQKFKGKATLTADKSSSTAYMQLSSLASEDSAVYYCARGKVYYGSNPFAYWGQGTLVTVSATRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6843 - protein, 1092 aa, Artificial Sequence
  Synthetic Polypeptide encoding a CAR with optional accessory module(s)
MALPVTALLLPLALLLHAARPDIVMTQSHKFMSTSVGDRVSITCKASQDVSTAVAWYQQKPGQSPKLLIYSASYRYTGVPDRFTGSGSGTDFTFTISSVQAEDLAVYYCQQHYSTPPYTFGGGTKLEIKGGGGSGGGGSGGGGSQVQLQQSGPELVKPGASVKISCKASGYAFSSSWMNWVKQRPGQGLEWIGRIYPGDGDTKYNGKFKGKATLTADKSSSTAYMQLSSLTSVDSAVYFCARSTMIATGAMDYWGQGTSVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6844 - protein, 1097 aa, Artificial Sequence
  Synthetic Polypeptide encoding a CAR with optional accessory module(s)
MALPVTALLLPLALLLHAARPQSVLTQPPSVSGAPGQRVTISCTGSGSNIGAPYDVSWYQQLPGTAPKLLIYHNNKRPSGVPDRFSGSKSGTSASLAITGLQAEDEADYYCATVEAGLSGSVFGGGTKLTVLGAGGGGSGGGGSGGGGSQVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSPLTLGLWGQGTMVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6845 - protein, 1097 aa, Artificial Sequence
  Synthetic Polypeptide encoding a CAR with optional accessory module(s)
MALPVTALLLPLALLLHAARPQSVLTQPPSVSGAPGQRVTISCTGSGSNIGAPYDVSWYQQLPGTAPKLLIYHNNKRPSGVPDRFSGSKSGTSASLAITGLQAEDEADYYCQSYDSSSISTIFGGGTKLTVLGAGGGGSGGGGSGGGGSQVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSGIAYRPWGQGTMVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6846 - protein, 1108 aa, Artificial Sequence
  Synthetic Polypeptide encoding a CAR with optional accessory module(s)
MALPVTALLLPLALLLHAARPDEFEVQLVESGGGLVQAGGSLRLSCVASGISSSKRNMGWYRQAPGKQRESVATISSGGNKDYTDAVKDRFTISRDTTKNTVYLQMNSLKPEDTAVYYCKIEAGTGWATRRGYTYWGQGTLVTVSSLEGGGGSGGGGSGGGGSFEVQLVESGGGLVQAGGSLRLSCAASGSIFSGNVMGWYRRQAPGKEREWVAAIASGGSIYYRDSVKGRFTISRDNAKNTVYLQMNSLKPEDTAVYYCNSHPPTLPYWGLGTQVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6847 - protein, 1142 aa, Artificial Sequence
  Synthetic Polypeptide encoding a CAR with optional accessory module(s)
MALPVTALLLPLALLLHAARPDEFEVQLVESGGGLVQAGDSLRLSCAASGRAFSRYAMGWFRQAPGKEREFVAAIGWGPSKTNYADSVKGRFTISRDNAKNTVYLQMNTLKPEDTAVYSCAAKFVNTDSTWSRSEMYTYWGQGTLVTVSSLEGGGGSGGGGSGGGGSGSGGSGSGGSGSGGSGSGGSFEVQLVESGGGSVQAGGSLRLSCTTSGRALNMYVMGWFRQAPGNEREFVAATSSSGGSTSYPDSVKGRFTISRDNAKNTVYLQMNSLKPEDTAAYRCAASPYVSTPTMNILEEYRYWGLGTQVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6848 - protein, 1095 aa, Artificial Sequence
  Synthetic Polypeptide encoding a CAR with optional accessory module(s)
MALPVTALLLPLALLLHAARPDIQMTQSPSSLSASVGDRVTITCSASSSVSYMYWYQQKPGKAPKLLIYLTSNLASGVPSRFSGSGSGTDFTLTISSLQPEDFATYYCQQWRSNPFTFGQGTKLEIKRGGGGSGGGGSGGGGSQITLKESGPTLVKPTQTLTLTCTFSGFSLSTSGMGVGWIRQPPGKALEWLAHIWWDDVKRYSPSLKSRLTITKDTSKNQVVLTMTNMDPVDTATYYCARIVSFDNDVVSAMDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6849 - protein, 1090 aa, Artificial Sequence
  Synthetic Polypeptide encoding a CAR with optional accessory module(s)
MALPVTALLLPLALLLHAARPEIVMTQSPATLSVSPGERATLSCKASQSVSNDVVWYQQKPGQAPRLLIYYASNRYTGIPARFSGSGSGTEFTLTISSLQSEDFAVYYCQQDYTSPWTFGQGTKLEIKRGGGGSGGGGSGGGGSQVQLVQSGAEVKKPGASVKVSCKASGYTFTNYGMNWVRQAPGQGLEWMGWINTYTGEPTYADDFKGRVTMTTDTSTSTAYMELRSLRSDDTAVYYCARIGDSSPSDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6850 - protein, 1091 aa, Artificial Sequence
  Synthetic Polypeptide encoding a CAR with optional accessory module(s)
MALPVTALLLPLALLLHAARPDSTDIQMTQSPSSLSASVGDRVTITCRASQSISSYLNWYQQKPGKAPKLLIYLASNLQSGVPSRFSGSGSGTDFTLTISSLQPEDFATYYCQQAEYMPLTFGQGTKVEIKRAGGGGSGGGGSGGGGSEVQLLESGGGLVQPGGSLRLSCAASGFTFSGYAMSWVRQAPGKGLEWVSEIAPPGLNTRYADSVKGRFTISRDNSKNTLYLQMNSLRAEDTAVYYCAKSDTAFDYWGQGTLVTVSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6851 - protein, 1094 aa, Artificial Sequence
  Synthetic Polypeptide encoding a CAR with optional accessory module(s)
MALPVTALLLPLALLLHAARPDQAVLTQESALTTSPGETVTLTCRSSTGAVTTSNYANWVQEKPDHLFTGLIGGTNNRVPGVPARFSGSLIGDKAALTITGAQTEDEAIYFCVLWHSNHWVFGGGTKLTVLGGGGSGGGGSGGGGSDVQLVESGGGLVQPGGSRKLSCAASGFTFSSFGMHWVRQAPEKGLEWVAYISSGSSTLHYADTVKGRFTISRDNPKNTLFLQMTSLRSEDTAMYYCARWGNYPHYAMDYWGQGTSVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6852 - protein, 976 aa, Artificial Sequence
  Synthetic Polypeptide encoding a CAR with optional accessory module(s)
MALPVTALLLPLALLLHAARPDEFEVQLVESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6853 - protein, 1118 aa, Artificial Sequence
  Synthetic Polypeptide encoding a CAR with optional accessory module(s)
MALPVTALLLPLALLLHAARPDEFEVQLVESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTLVTVSSLEGGGGSGGGGSGGGGSFEEVQLVESGGGSVQAGGSLRLSCAASGDTYGSYWMGWFRQAPGKEREGVAAINRGGGYTVYADSVKGRFTISRDTAKNTVYLQMNSLRPDDTADYYCAASGVLGGLHEDWFNYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6854 - protein, 1137 aa, Artificial Sequence
  Synthetic Polypeptide encoding a CAR with optional accessory module(s)
MALPVTALLLPLALLLHAARPDEFEVQLVESGGGSVQAGGSLRLTCAASGSTSRSYGMGWFRQAPGKEREFVSGISWRGDSTGYADSVKGRFTISRDNAKNTVDLQMNSLKPEDTAIYYCAAAAGSTWYGTLYEYDYWGQGTLVTVSSLEGGGGSGGGGSGGGGSGSGGSGSGGSGSGGSGSGGSFEVQLVESGGGSVQAGGSLRLSCAASGDTYGSYWMGWFRQAPGQEREAVAAINRGGGYTVYADSVKGRFTISRDNAKNTLYLQMNSLRPDDTADYYCAASGVLGGLHEDWFNYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6855 - protein, 1085 aa, Artificial Sequence
  Synthetic Polypeptide encoding a CAR with optional accessory module(s)
MALPVTALLLPLALLLHAARPDIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVEGGGGSGGGGSGGGGSEVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6856 - protein, 1091 aa, Artificial Sequence
  Synthetic Polypeptide encoding a CAR with optional accessory module(s)
MALPVTALLLPLALLLHAARPDEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSGGGGSGGGGSGGGGSDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6857 - protein, 1098 aa, Artificial Sequence
  Synthetic Polypeptide encoding a CAR with optional accessory module(s)
MALPVTALLLPLALLLHAARPDELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6858 - protein, 1099 aa, Artificial Sequence
  Synthetic Polypeptide encoding a CAR with optional accessory module(s)
MALPVTALLLPLALLLHAARPDELQMTQSPSSLSASVGDRVTITCRASQSISSYLNWYQQKPGQPPKLLIYWASTRESGVPDRFSGSESGTNYTLTISSLQPEDFATYFCQQSDSLPITFGQGTRLDIQGGGGSGGGGSGGGGSEVQLLESGGGVVQPGRSLRLSCAASGFTFSSYGMHWVRQAPGKGLEWVAVISYDGSNKYYADSVKGRFTISRDNSKNTLYLQMNSLRAEDTAVYYCAKDMGWGSGWRPYYYYGMDVWGQGTTVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6859 - protein, 1096 aa, Artificial Sequence
  Synthetic Polypeptide encoding a CAR with optional accessory module(s)
MALPVTALLLPLALLLHAARPDDIQMTQSPSSLSASVGDRVTITCRASQSISSYLNWYQQKPGKAPKLLIYAASSLQSGVPSRFSGSGSGTDFTLTISSLQPEDLATYYCQQSYSTPFTFGPGTKVDIKGGGGSGGGGSGGGGSVHEVQLVQSGAEVKKPGSSVKVSCKASGGTFSSYAISWVRQAPGQGLEWMGGIIPIFGTANYAQKFQGRVTITADKSTSTAYMELSSLRSEDTAVYYCATFALFGFREQAFDIWGQGTTVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6860 - protein, 1093 aa, Artificial Sequence
  Synthetic Polypeptide encoding a CAR with optional accessory module(s)
MALPVTALLLPLALLLHAARPDVVMTQTPLSLPVSLGDQASISCRSSQSLVHSNGNTYLRWYLQKPGQSPKVLIYKVSNRFSGVPDRFSGSGSGTDFTLKISRVEAEDLGVYFCSQSTHVPWTFGGGTKLEIKGGGGSGGGGSGGGGSEVKLDETGGGLVQPGRPMKLSCVASGFTFSDYWMNWVRQSPEKGLEWVAQIRNKPYNYETYYSDSVKGRFTISRDDSKSSVYLQMNNLRVEDMGIYYCTGSYYGMDYWGQGTSVTVSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6861 - protein, 1104 aa, Artificial Sequence
  Synthetic Polypeptide encoding a CAR with optional accessory module(s)
MALPVTALLLPLALLLHAARPDVVMTQTPLSLPVSLGDQASISCRSSQSLVHSNGNTYLRWYLQKPGQSPKVLIYKVSNRVSGVPDRFSGSGSGTDFTLKINRVEAEDLGVYFCSQSTHVPWTFGGGTKLEIKSSADDAKKDAAKKDDAKKDDAKKDGGVKLDETGGGLVQPGGAMKLSCVTSGFTFGHYWMNWVRQSPEKGLEWVAQFRNKPYNYETYYSDSVKGRFTISRDDSKSSVYLQMNNLRVEDTGIYYCTGASYGMEYLGQGTSVTVSTTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6862 - protein, 1100 aa, Artificial Sequence
  Synthetic Polypeptide encoding a CAR with optional accessory module(s)
MALPVTALLLPLALLLHAARPQVQLVESGGNLVQPGGSLRLSCAASGFTFGSFSMSWVRQAPGGGLEWVAGLSARSSLTHYADSVKGRFTISRDNAKNSVYLQMNSLRVEDTAVYYCARRSYDSSGYWGHFYSYMDVWGQGTLVTVSGGGGSGGGGSGGGGSSVLTQPSSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLGTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6863 - protein, 1095 aa, Artificial Sequence
  Synthetic Polypeptide encoding a CAR with optional accessory module(s)
MALPVTALLLPLALLLHAARPDIQMTQSPSSLSASVGDRVTITCRTSQSLSSYTHWYQQKPGKAPKLLIYAASSRGSGVPSRFSGSGSGTDFTLTISSLQPEDFATYYCQQSRTFGQGTKVEIKGGGGSGGGGSGGGGSQVQLQQSGPGLVKPSQTLSLTCAISGDSVSSYNAVWNWIRQSPSRGLEWLGRTYYRSGWYNDYAESVKSRITINPDTSKNQFSLQLNSVTPEDTAVYYCARSGHITVFGVNVDAFDMWGQGTMVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6864 - protein, 1094 aa, Artificial Sequence
  Synthetic Polypeptide encoding a CAR with optional accessory module(s)
MALPVTALLLPLALLLHAARPDIVLTQSPLSLAVSLGQPAIISCKASQSVSFAGTSLMHWYHQKPGQQPRLLIYRASNLEAGVPDRFSGSGSKTDFTLTISPVEAEDAATYYCQQSREYPYTFGGGTKLEIKRGGGGSGGGGSGGGGSQVQLVQSGAEVVKPGASVKISCKASGYTFTGYFMNWVKQSPGQSLEWIGRIHPYDGDTFYNQKFQGKATLTVDKSSNTAHMELLSLTSEDFAVYYCTRYDGSRAMDYWGQGTTVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6865 - protein, 1067 aa, Artificial Sequence
  Synthetic Polypeptide encoding a CAR with optional accessory module(s)
MALPVTALLLPLALLLHAARPNSCELTNITIAIEKEECRFCISINTTWCAGYCYTRDLVYKDPARPKIQKTCTFKELVYETVRVPGCAHHADSLYTYPVATQCHCGKCDSDSTDCTVRGLGPSYCSFGEMKEGGGGSGGGGSGGGGSAPDVQDCPECTLQENPFFSQPGAPILQCMGCCFSRAYPTPLRSKKTMLVQKNVTSESTCCVAKSYNRVTVMGGFKVENHTACHCSTCYYHKSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6866 - protein, 1098 aa, Artificial Sequence
  Synthetic Polypeptide encoding a CAR with optional accessory module(s)
MALPVTALLLPLALLLHAARPDLETTLTQSPATLSVSPGERVTLSCRASQSVGSNLAWYQQKFGQAPRLLIYDASTRATGIPARFSGSGSGTEFTLTISRLEPEDFAVYYCHQYGSSPRTFGQGTKVDIKRGGGGSGGGGSGGGGSQVQLVQSGAEVKKPGASVKVSCKASGYTFTTYGISWVRQAPGQGLEWMGWISAYNGHTNYAQMLQGRVTMTTDTSTSTAYMELRGLRSDDTAVYYCAREAYASYGSGSYWTDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6867 - protein, 1091 aa, Artificial Sequence
  Synthetic Polypeptide encoding a CAR with optional accessory module(s)
MALPVTALLLPLALLLHAARPDDVVMTQTPLSLPVTPGEPASISCRSSQSLVHRNGNTYLHWYLQKPGQSPKLLIHKVSNRFSGVPDRFSGSGSGTDFTLKISRVEAEDLGVYFCSQSTHVPPLTFGAGTKLELKGGGGSGGGGSGGGGSEVQLVQSGAEVEKPGASVKISCKASGSSFTGYNMNWVRQNIGKSLEWIGAIDPYYGGTSYNQKFKGRATLTVDKSTSTAYMHLKSLRSEDTAVYYCVSGMEYWGQGTSVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6868 - protein, 1089 aa, Artificial Sequence
  Synthetic Polypeptide encoding a CAR with optional accessory module(s)
MALPVTALLLPLALLLHAARPDEIVMTQTPATLSVSAGERVTITCKASQSVSNDVTWYQQKPGQAPRLLIYSASNRYSGVPARFSGSGYGTEFTFTISSVQSEDFAVYFCQQDYSSFGQGTKLEIKRGGGGSGGGGSGGGGSQVQLVESGPGVVQPGRSLRISCAVSGFSVTNYGVHWVRQPPGKGLEWLGVIWAGGITNYNSAFMSRLTISKDNSKNTVYLQMNSLRAEDTAMYYCASRGGHYGYALDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6869 - protein, 1091 aa, Artificial Sequence
  Synthetic Polypeptide encoding a CAR with optional accessory module(s)
MALPVTALLLPLALLLHAARPDIQMTQTASSLPASLGDRVTISCSASQDISNYLNWYQQKPDGTVKLLIFYSSNLHSGVPSRFSGGGSGTDYSLTISNLEPEDIATYFCHQYSKLPWTFGGGTKLEIKRGGGGSGGGGSGGGGSEVTLVESGGDFVKPGGSLKVSCAASGFAFSHYAMSWVRQTPAKRLEWVAYISSGGSGTYYSDSVKGRFTISRDNAKNTLYLQMRSLRSEDSAMYFCTRVKLGTYYFDSWGQGTTLTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6870 - protein, 1093 aa, Artificial Sequence
  Synthetic Polypeptide encoding a CAR with optional accessory module(s)
MALPVTALLLPLALLLHAARPQFVLTQSPSASAALGASAKLTCTLSSAHKTYTIDWYQQQKGKAPRYLIQVKSDGTYTKATGVPDRFSGSSSGADRYLIIPSVQADDEADYYCGTDYTGGYVFGGGTQLTVTGGGGSGGGGSGGGGSEQLKESGGGLFKPTDTLTLTCTVSGFSLSYYGVNWVRQAPGNGLEWIGTIGGSGDTYYASWAKSRSTIIRNTNENTVTLKMTSLTAADTATYFCVRYANIGYEYFNVWGPGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6871 - protein, 1098 aa, Artificial Sequence
  Synthetic Polypeptide encoding a CAR with optional accessory module(s)
MALPVTALLLPLALLLHAARPQFVLTQSPSVSAALGASAKLTCTLSSAHKTYTIDWYQQQQGEAPRYLMQVKSDGSYTKGTGVPDRFSGSSSGADRYLIIPSVQADDEAGYVCGADDNGGYVFGGGTQLTVTGGGGSGGGGSGGGGSQSVKESEGGLFKPTDTLTLTCTVSGFSLSRHALTWVRQAPGNGLEWIGAIDNAGTTYYASWAKSRSTITRNTDLHTVTLKMTSLTASDTATYFCARVFYDINSGYYLDGMDLWGPGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6872 - protein, 1092 aa, Artificial Sequence
  Synthetic Polypeptide encoding a CAR with optional accessory module(s)
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKGGGGSGGGGSGGGGSEVQLVESGGGLVQPGESLRLSCVASGFTFSRYKMNWVRQAPGKGLEWVSYISRSGRDIYYADSVKGRFTISRDNAKNSLYLQMNSLRDEDTAVYYCAGTVTTYYYFGMDVWGHGTTVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6873 - protein, 1093 aa, Artificial Sequence
  Synthetic Polypeptide encoding a CAR with optional accessory module(s)
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKGGGGSGGGGSGGGGSEVQLVESGGGSVQPGESLRLSCVASGFTFSRYKMNWVRQAPGKGLEWVSYISRSGRDIYYADSVKGRFTISRDNAKNSLYLQMNSLRDEDTAVYYCAGTVTTYYYDFGMDVWGQGTTVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6874 - protein, 1092 aa, Artificial Sequence
  Synthetic Polypeptide encoding a CAR with optional accessory module(s)
MALPVTALLLPLALLLHAARPQSVLTQPPSASGTPGQRVTISCSGSRSNVGGNYVFWYQQVPGATPKLLIYRSNQRPSGVPDRFAGSKSGSSASLAISGLRSEDEADYYCATWDDSLSGFVFGTGTKVTVLGGGGGSGGGGSGGGGSEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARGYGKAYDQWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6875 - protein, 1091 aa, Artificial Sequence
  Synthetic Polypeptide encoding a CAR with optional accessory module(s)
MALPVTALLLPLALLLHAARPQSVVTQPPSMSAAPGQQVTISCSGGNSNIERNYVSWYLQLPGTAPKLVIFDNDRRPSGIPDRFSGSKSGTSATLGITGLQTGDEADYYCGTWDSSLRGWVFGGGTKLTVLGGGGGSGGGGSGGGGSEVQLVESGGGLIQPGGSLRLSCAASGFTFSNYAMNWVRQAPGKGLEWVSTINGRGSSTIYADSVKGRFTISRDNSKNTLYLQMNSLRAEDTATYYCARYISRGLGDSWGQGTLVTVTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6876 - protein, 1091 aa, Artificial Sequence
  Synthetic Polypeptide encoding a CAR with optional accessory module(s)
MALPVTALLLPLALLLHAARPQSVVTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSYVFGTGTKLTVLGGGGGSGGGGSGGGGSEVQLVETGGNLVQPGASLRLSCAASGFSFSGTAMHWVRQAPGKGLEWVSTISSTGRSTYYRDSVKGRFTISRDNSKNTLYLQMNSLRGEDTAVYYCARVSFDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6877 - protein, 1093 aa, Artificial Sequence
  Synthetic Polypeptide encoding a CAR with optional accessory module(s)
MALPVTALLLPLALLLHAARPQSVVTQPASVSGSPGQSITISCTGTSSDVGGYNYVSWYQQHPGKAPKLMIYDVSKRPSGVSNRFSGSKSGNTASLTISGLQAEDEADYYCSSYTSSSTLVFGGGTKLTVLGGGGGSGGGGSGGGGSEVQLVESGGAFVQPGGSLRLSCAASGFTFSSYAMTWVRQAPGKGLEWVSTISGRGRSTFYADSVKGRFTISRDNSKNTLYLQMNSLRAEDTAVYYCARYYHAGAFDLWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6878 - protein, 1091 aa, Artificial Sequence
  Synthetic Polypeptide encoding a CAR with optional accessory module(s)
MALPVTALLLPLALLLHAARPDNIELTQSPAIMSASPGERVTMTCSASSSIRYIYWYQQKPGSSPRLLIYDTSNVAPGVPFRFSGSGSGTSYSLTINRMEAEDAATYYCQEWSGYPYTFGGGTKLDIKRGGGGSGGGGSGGGGSQVKLQESGGGLVKPGGSLKLSCAASGFTFSSYGMSWVRQTPDKRLEWVATISSGGSYTYYPDSVKGRFTISRDNAKNTLYLQMSSLKSEDTAMYYCARGNWEGWYFDVWGQGTTVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6879 - protein, 1101 aa, Artificial Sequence
  Synthetic Polypeptide encoding a CAR with optional accessory module(s)
MALPVTALLLPLALLLHAARPDNFMLTQPHSVSESPGKTVTISCTGSGGSIDNNYVHWYQQRPGSAPTTVMFEDNQRPSGVPDRFSGSIDSSSNSASLVISGLKTEDEGDYYCQSSDGSKVVFGGGTKLTVLGQGGGGSGGGGSGGGGSEVQLVQSGGGSLTLSCAASGVVQPGRFTFSSYGMHWVRQAPGKGLEWVSVISYDGSNKYYADSVKGRFTISRDNSKNTLYLQMNSLRTEDTAVYYCAKTLSAGEWIGGGAFDIWGHGTMVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6880 - protein, 1091 aa, Artificial Sequence
  Synthetic Polypeptide encoding a CAR with optional accessory module(s)
MALPVTALLLPLALLLHAARPDVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQNTPVPPKFGSGTKLEIKGGGGSGGGGSGGGGSQVQLQQSGAELVRPGASVKLSCKASGYTFNDYEMHWVKQTPVHGLKWIGALEPKTGDTAYSQKFKGKATLTADKSSSTAYMELRSLTSEDSAVYYCTSCYYYTYSGQGTLVTVSATRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6881 - protein, 1090 aa, Artificial Sequence
  Synthetic Polypeptide encoding a CAR with optional accessory module(s)
MALPVTALLLPLALLLHAARPDIQLTQSPSSLSASVGDRVTITCRASQGIRNDLGWYQQKPGKAPKRLIYAASSLQNGVPSRFSGSGSGTEFTLTISSLQPEDFATYYCLQHNTYPAFGQGTKVEIKRGGGGSGGGGSGGGGSQVQLQESGPGLVKPSQTLSLTCTVSGGSISSFNYYWSWIRHHPGKGLEWIGYIYYSGSTYSNPSLKSRVTISVDTSKNQFSLTLSSVTAADTAVYYCARGYNWNYFDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6882 - protein, 1092 aa, Artificial Sequence
  Synthetic Polypeptide encoding a CAR with optional accessory module(s)
MALPVTALLLPLALLLHAARPDDIVLTQSPASLAVSLGQSVTISCRASESVEYYGTSLMQWYQQKPGQPPKLLIYATSNVESGVPARFSGSGSGTDFSLNIHPVEEDDIAMYFCQQSRKLPSTFGGGTKLEIKGGGGSGGGGSGGGGSDVRLQESGPGQVKPSQTVSLTCSVTGYSITNGNHWWNWIRQVSGSKLEWIGYISSSGSTDSNPSLKSRISITRDTSKNQLFLQLNSVTTEDIATYYCARGYYFDYWGQGTTLTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6883 - protein, 970 aa, Artificial Sequence
  Synthetic Polypeptide encoding a CAR with optional accessory module(s)
MALPVTALLLPLALLLHAARPDEFEVQLVESGGGLVQAGGSLRLSCAASGITFSINTMGWYRQAPGKQRELVALISSIGDTYYADSVKGRFTISRDNAKNTVYLQMNSLKPEDTAVYYCKRFRTAAQGTDYWGQGTQVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6884 - protein, 905 aa, Artificial Sequence
  Synthetic Polypeptide encoding a CAR with optional accessory module(s)
MDWIWRILFLVGAATGAHSFEGSGFEYAKEMRNAYWEIALLPNLTNQQKRAPIRKLYDDPSQSSELLSEAKKLNDSQTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6885 - protein, 976 aa, Artificial Sequence
  Synthetic Polypeptide encoding a CAR with optional accessory module(s)
MALPVTALLLPLALLLHAARPDEFGSDLGIKLLFAAAKGQDDEVRILLAAGADVNAKDFEGYTPLHVAAYDGHLEIVEVLLKAGADVNAKDSQGRTPLHEAAYSGHLEIVEVLLKAGADVNAQDDAGETPADLAAAWGHEDIAEVLQKTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6886 - protein, 975 aa, Artificial Sequence
  Synthetic Polypeptide encoding a CAR with optional accessory module(s)
MDWIWRILFLVGAATGAHSFERSDLGKKLLEAARAGQDDEVRILMANGADVNAKDEYGLTPLYLATAHGHLEIVEVLLKNGADVNAVDAIGFTPLHLAAFIGHLEIAEVLLKHGADVNAQDKFGKTAFDISIGNGNEDLAEILQKLNTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6887 - protein, 1127 aa, Artificial Sequence
  Synthetic Polypeptide encoding a CAR with optional accessory module(s)
MALPVTALLLPLALLLHAARPDEFEVQLVESGGGLVQAGGSLRLSCAASGITFSINTMGWYRQAPGKQRELVALISSIGDTYYADSVKGRFTISRDNAKNTVYLQMNSLKPEDTAVYYCKRFRTAAQGTDYWGQGTQVTVSSLEGGGGSGGGGSGGGGSGSGGSGSGGSGSGGSGSGGSFEVQLVESGGGLVQPGGSLRLSCAASGSIFGFNDMAWYRQAPGKQRELVALISRVGVTSSADSVKGRFTISRVNAKDTVYLQMNSLKPEDTAVYYCYMDQRLDGSTLAYWGQGTQVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6888 - protein, 1091 aa, Artificial Sequence
  Synthetic Polypeptide encoding a CAR with optional accessory module(s)
MALPVTALLLPLALLLHAARPDIQMTQSPSSLSASVGDRVTITCRASQDVNTAVAWYQQKPGKAPKLLIYSASFLESGVPSRFSGSRSGTDFTLTISSLQPEDFATYYCQQHYTTPPTFGQTKVEIKRGGGGSGGGGSGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDVWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6889 - protein, 970 aa, Artificial Sequence
  Synthetic Polypeptide encoding a CAR with optional accessory module(s)
MALPVTALLLPLALLLHAARPDEFDVQLVESGGGLVQPGGSLRLSCAASGSIGGLNAMAWYRQAPGKERELVAGIFGVGSTRYADSVKGRFTISRDNSKNTVYLQMNSLRPEDTAVYYCRMSSVTRGSSDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6890 - protein, 910 aa, Artificial Sequence
  Synthetic Polypeptide encoding a CAR with optional accessory module(s)
MALPVTALLLPLALLLHAARPDEFVDNKFNKERYSAYYEIWQLPNLNVRQKAAFIGSLQDDPSQSANLLAEAKKLNDAQAPKTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6891 - protein, 1132 aa, Artificial Sequence
  Synthetic Polypeptide encoding a CAR with optional accessory module(s)
MALPVTALLLPLALLLHAARPDEFDVQLVESGGGLVQPGGSLRLSCAASGSIGGLNAMAWYRQAPGKERELVAGIFGVGSTRYADSVKGRFTISRDNSKNTVYLQMNSLRPEDTAVYYCRMSSVTRGSSDYWGQGTLVTVSSLEGGGGSGGGGSGGGGSGSGGSGSGGSGSGGSGSGGSFEVQLVESGGSLVQPGGSLRLSCAASGFTFDDYAMSWVRQVPGKGLEWVSSINWSGTHTDYADSVKGRFTISRNNANNTLYLQMNSLKSEDTAVYYCAKNWRDAGTTWFEKSGSAGQGTQVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6892 - protein, 1090 aa, Artificial Sequence
  Synthetic Polypeptide encoding a CAR with optional accessory module(s)
MALPVTALLLPLALLLHAARPDQSVLTQPPSVSVAPGKTARIPCEGNYIGSSNVHWYQQKPGQAPVLVIHFDSDRPSGIPDRFSGSNSGNMATLTISRVEAGDEADYYCQVWENHGWVFGGGTKLTVLSGGGGSGGGGSGGGGSEVQLVETGGGLVQPGESLRLSCAASGFTFSDYEMNWVRQAPGKGLEWVSYISSSGSTIYYADSVKGRFTIYRDNAKNSLYLQMNSLRAEDTALYYCARAWGVGPPDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6893 - protein, 1098 aa, Artificial Sequence
  Synthetic Polypeptide encoding a CAR with optional accessory module(s)
MALPVTALLLPLALLLHAARPDIQMTQSPSSLSASVGDTVTITCQANGYLNWYQQRRGKAPKLLIYDGSKLERGVPSRFSGRRWGQEYNLTINNLQPEDIATYFCQVYEFVVPGTRLDLKRTVAAPGGGGSGGGGSGGGGSQVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVSSASTKGPTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6894 - protein, 1104 aa, Artificial Sequence
  Synthetic Polypeptide encoding a CAR with optional accessory module(s)
MALPVTALLLPLALLLHAARPQSALTQPPSASGSPGQSITISCTGTSNNFVSWYQQHAGKAPKLVIYDVNKRPSGVPDRFSGSKSGNTASLTVSGLQTDDEAVYYCGSLVGNWDVIFGGGTKLTVLGGGGSGGGGSGGGGSQPQLQESGPTLVEASETLSLTCAVSGDSTAACNSFWGWVRQPPGKGLEWVGSLSHCASYWNRGWTYHNPSLKSRLTLALDTPKNLVFLKLNSVTAADTATYYCARFGGEVLRYTDWPKPAWVDLWGRGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6895 - protein, 1089 aa, Artificial Sequence
  Synthetic Polypeptide encoding a CAR with optional accessory module(s)
MALPVTALLLPLALLLHAARPEIVLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIKRGGGGSGGGGSGGGGSQVQLVQSGGQMKKPGESMRISCRASGYEFIDCTLNWIRLAPGKRPEWMGWLKPRGGAVNYARPLQGRVTMTRDVYSDTAFLELRSLTVDDTAVYFCTRGKNCDYNWDFEHWGRGTPVIVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6896 - protein, 1099 aa, Artificial Sequence
  Synthetic Polypeptide encoding a CAR with optional accessory module(s)
MALPVTALLLPLALLLHAARPELVLTQSPGTLSLSAGERATLSCRASQSVSSGSLAWYQQKPGQAPRLLIYGASTRATGIPDRFSGSGSGTDFTLTIGRLEPEDLAVYYCQQYGTSPYTFGQGTKLEIGGGGSGGGGSGGGGSLEQSGAEVKKPGSSVQVSCKASGGTFSMYGFNWVRQAPGHGLEWMGGIIPIFGTSNYAQKFRGRVTFTADQATSTAYMELTNLRSDDTAVYYCARDFGPDWEDGDSYDGSGRGFFDFWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6897 - protein, 1095 aa, Artificial Sequence
  Synthetic Polypeptide encoding a CAR with optional accessory module(s)
MALPVTALLLPLALLLHAARPDVVMTQSPSSLSASVGDRVTITCQSSLDISHYLNWYQQKPGKAPKLLIYDASNLETGVPSRFSGSGSGTHFTFTISSLQPEDFATYYCQQYDNLPLTFGGGTKLEIKRGGGGSGGGGSGGGGSQVQLVQSGGGVVQPGGSLRVSCAASGVTLSDYGMHWVRQAPGKGLEWVAFIRNDGSDKYYADSVKGRFTISRDNSEKTVSLQMSSLRAEDTAVYYCAKNGESGPLDYWYLDLWGRGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6898 - protein, 1095 aa, Artificial Sequence
  Synthetic Polypeptide encoding a CAR with optional accessory module(s)
MALPVTALLLPLALLLHAARPDDIVMTQSQDSMATSVGERVTVNCKASQNVDTNVAWYQQKPGQSPEPLLFSASYRYTGVPDRFSGSGSGTDFTLTISSVQAEDVAEYFCQQYNSYPLTFGQGTKLEIKRGGGGSGGGGSGGGGSEVQVEVSGGGLVQPGGSMRLSCAVSGFTFSNYWMNWVRQSPEKGLEWIAEIRLKSNNFARYYAESVKGRFTISRDNSKNSLYLQMISLRAEDTAIYYCTSYGNYVGHYFDHWGQGTLLTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6899 - protein, 1099 aa, Artificial Sequence
  Synthetic Polypeptide encoding a CAR with optional accessory module(s)
MALPVTALLLPLALLLHAARPSYELTQPPSVSGTPGQRVAISCSGSSSNIGTRMVTWYQHVPGTAPKLLIFNNNQRPSGVPDRFSASKSGTSASLAIIGLQSDDEADYYCATWDDNVKSYVFGTGTKVTVLGSRGGGGSGGGGSGGGGSLEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARAPQSWYVGDVWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6900 - protein, 1096 aa, Artificial Sequence
  Synthetic Polypeptide encoding a CAR with optional accessory module(s)
MALPVTALLLPLALLLHAARPQSVLTQPPSLSVAPGKTASITCGGNNIGMKSVHWYQQRPGQAPVLVIYYDSDRPSGIPGRFSGSNSGNTATLTISRVEAGDEADYYCQVWDTTGDHPGYVFGTGTKVTVLGGGGSGGGGSGGGGSQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGVYGYSGSAPYDEWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6901 - protein, 1102 aa, Artificial Sequence
  Synthetic Polypeptide encoding a CAR with optional accessory module(s)
MALPVTALLLPLALLLHAARPDEIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPRTFGQGTKVEIKRGGGGSGGGGSGGGGSQVQLVQSGGGVVQPGRSLRLSCAASGFTFSSYGMHWVRQAPGKGLEWVAVISYDGSNKYYADSVKGRFTISRDNSKNTLYLQMNSLRAEDTAVYYCARDFDYGDSYYYYGMDVWGQGTTVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6902 - protein, 1096 aa, Artificial Sequence
  Synthetic Polypeptide encoding a CAR with optional accessory module(s)
MALPVTALLLPLALLLHAARPDEIVLTQSPATLSLSPGERATLSCRASQSVGSYLAWYQQKPGAPRLLIYDASHRATGIPARFSGSGSGTDFTLTISSLEPEDFAVYYCQQRSNWPPMYTFGQGTKLEIKRGGGGSGGGGSGGGGSEVQLVQSGAEVSVKVSCKASGGKKPGSTFSSYTISWVRQAPGQGLEWMGGIIPIFGTANYAQKFQGRVTITADKSTSTAYMELSSLRSEDTAVYYCAGDTDSSGYYGAVDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6903 - protein, 1079 aa, Artificial Sequence
  Synthetic Polypeptide encoding a CAR with optional accessory module(s)
MALPVTALLLPLALLLHAARPDIQMTQSPSSLSASVGDRVTITCQASQDINNYLNWYQQKPGKAPKLLIYDASNLQTGVPSRFSGSGSGTDFTFTIEDIATYYCQQYTFGPGTKVDIKGGGGSGGGGSGGGGSEVQLLESGGGLVQPGGSLRLSCAASGFTFSWYSMTWVRQAPGKGLEWVSSIVPWGDFTQYADSVKGRFTISRDNSKNTLYLQMNSLRAEDTAVYYCAKGPGWGSFDLWGRGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6904 - protein, 968 aa, Artificial Sequence
  Synthetic Polypeptide encoding a CAR with optional accessory module(s)
MDWIWRILFLVGAATGAHSEVQLVESGGGLVQPGGSLRLSCAASGSVFKINVMAWYRQAPGKGRELVAGIISGGSTSYADSVKGRFTISRDNAKNTLYLQMNSLRPEDTAVYYCAFITTESDYDLGRRYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6905 - protein, 1089 aa, Artificial Sequence
  Synthetic Polypeptide encoding a CAR with optional accessory module(s)
MALPVTALLLPLALLLHAARPDIQMTQSPSSLSASVGDRVTITCTASLSVSSTYLHWYQQKPGSSPKLWIYSTSNLASGVPSRFSGSGSGTSYTLTISSLQPEDFATYYCHQYHRSPLTFGGGTKVEIKRGGGGSGGGGSGGGGSEVQLVESGGGLVQPGGSLRLSCAASGFSLTKYGVHWVRQAPGKGLEWVGVKWAGGSTDYNSALMSRFTISKDNAKNSLYLQMNSLRAEDTAVYYCARDHRDAMDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6906 - protein, 1093 aa, Artificial Sequence
  Synthetic Polypeptide encoding a CAR with optional accessory module(s)
MALPVTALLLPLALLLHAARPDIQMTQSPSSLSASVGDRVTITCKASQDVGTAVAWYQQKPGKAPKLLIYSASYRSTGVPSRFSGSGSGTDFTLTISSLQPEDFATYYCQHHYSAPWTFGGGTKVEIKGGGGSGGGGSGGGGSEVQLVESGGGLVQPGGSLRLSCAASGFTFSRNGMSWVRQAPGKGLEWVATVSSGGSYIYYADSVKGRFTISRDNAKNSLYLQMNSLRAEDTAVYYCARQGTTALATRFFDVWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6907 - protein, 1099 aa, Artificial Sequence
  Synthetic Polypeptide encoding a CAR with optional accessory module(s)
MALPVTALLLPLALLLHAARPDIVMTQSPSSLTMSVGQKVTMSCKSSHSLLNSRNQKNYLAWFQQKPGQSPKLLVYFASTRESGVPDRFIGSGSGTDFTLTISNVQAEDLADYFCQQHYTTLPTFGGGTKLEIKGGGGSGGGGSGGGGSQIQLVQSGPDLKKPGETVKISCKASGYTFTNTGMNWVKQAPGKGLKWMGWINTYTGEPTYADDFKGRFTFSLETSASTAYLQINNLKNEDTATYFCTRWGYGSSLYYAMDYWGQGTSVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6908 - protein, 1089 aa, Artificial Sequence
  Synthetic Polypeptide encoding a CAR with optional accessory module(s)
MALPVTALLLPLALLLHAARPDIQMTQSPPSLSASVGGKVTITCKASQDIDRYMAWYQDKPGKGPKLLIHDTSTLQPGIPSRFSGSGSGRDYSFSISNLEPEDIATYYCLQYDNLWTFGGGTKLEIKRGGGGSGGGGSGGGGSQVQLVQSGAELVKPGASVKMSCKASGYIFTNYNIHWVKKSPGQGLEWIGAIYPGNGDAPYSQKFQDRATLTADTSSSTTYMELSSLTSEDSAVYYCVRANWDVAFAYWGQGTLVSVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6909 - protein, 1090 aa, Artificial Sequence
  Synthetic Polypeptide encoding a CAR with optional accessory module(s)
MALPVTALLLPLALLLHAARPDIQMTQSPASLSASVGETVTITCRVSGNIHNYLAWYQQKQGKSPQLLVYNAKTLADGVPSRFSGSGSGTQYSLKINSLQPEDFGSYYCQHFWSNPYTFGGGTKLEIKGGGGSGGGGSGGGGSQVQLQQSGASVKVSCKASELVRPGTGYAFTNYLIEWVKQRPGQGLEWIGVINPGSGGTNYNEKFKGKATLTADKSSSTAYMQLSSLTSDDSAVYFCARYRSYDWYFDVWGAGTTVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6910 - protein, 1095 aa, Artificial Sequence
  Synthetic Polypeptide encoding a CAR with optional accessory module(s)
MALPVTALLLPLALLLHAARPDDIQMTQSPSSLSASVGDRVTITCRSSQRIVHSNGNTYLEWYQQTPGKAPKLLIYKVSNRFSGVPSRFSGSGSGTDYTPTISSLQPEDIATYYCFQGSHVPPTFGQGTKLQITGGGGSGGGGSGGGGSEVQLVESGGGVVQPGRSLRLSCSSSGPTFSDYYMYWVRQAPGKGLEWVAYMSNVGAITDYPDTVKGRPTISRDNSKNTLFLMDSLRPEDTGVYFCARGTRDGSWFAYWGQGTPVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6911 - protein, 1089 aa, Artificial Sequence
  Synthetic Polypeptide encoding a CAR with optional accessory module(s)
MALPVTALLLPLALLLHAARPDIQMTQSFSSLSASVGDRVTITCRASQDISNYLNWYQQKPGKAPKLLIYYTSRLHSGVPSRFSGSGSGTDYTLTISSLQPEDFATYFCQQGNTLPWTFGGGTKLEIKRGGGGSGGGGSGGGGSEVQLVQSGGGLVQSGGSLRLSCRASGYTFTRYWMLWVRQRPGKGLEWVAEINPRNDRTNYNEKFKTRFTISVDRSKNTLYLQMDSLRAEDTAVYFCALGGGYAMDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6912 - protein, 1076 aa, Artificial Sequence
  Synthetic Polypeptide encoding a CAR with optional accessory module(s)
MEMLQGLLLLLLLSMGGAWASREPLRPWCHPINAILAVEKEGCPVCITVNTTICAGYCPTMMRVLQAVLPPLPQVVCTYRDVRFESIRLPGCPRGVDPVVSFPVALSCRCGPCRRSTSDCGGPKDHPLTCDHPQLSGLLFLGGGGSGGGGSGGGGSAPDVQDCPECTLQENPFFSQPGAPILQCMGCCFSRAYPTPLRSKKTMLVQKNVTSESTCCVAKSYNRVTVMGGFKVENHTACHCSTCYYHKSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6913 - protein, 1090 aa, Artificial Sequence
  Synthetic Polypeptide encoding a CAR with optional accessory module(s)
MALPVTALLLPLALLLHAARPDIQMTQSPASLSASVGETVTIICRASVNIYSYLAWYQQKQGKSPQLLVYNAKILAEGVPSRFSGSGSGTQFSLKINSLQPEDFGSYYCQHHYGTFTFGSGTKLEIKRGGGGSGGGGSGGGGSQVQLKESGPGLVAPSQSLSITCTISGFSLTSYGVHWVRQPPGKGLEWLVVIWSDGSTTYNSALKSRLSISKDNSKSQVFLKMNSLQTDDTAIYYCASHYGSTLAFASWGHGTLVTVSAATRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6914 - protein, 1098 aa, Artificial Sequence
  Synthetic Polypeptide encoding a CAR with optional accessory module(s)
MALPVTALLLPLALLLHAARPDIVMTQSHKFMSTSVGDRVSVTCKASQNVGNNVAWYQQKPGQSPKVLIYSASYRYSGVPDRFTGSGSGTDFTLTISNVQSEDLAEYFCQQYNTYPFTFGSGTKLEIKGGGGSGGGGSGGGGSEVQLEESGGGLVQPGGSMKLSCVASGFTFSNYWMNWVRQSPEKGLEWVAEIRFKSHNYATHFAESVKGRFTISRDDSKSSVYLQMNNLRAEDTGIYYCTRRIGNSDYDWWYFDVWGAGTSVTVSSASTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6915 - protein, 1094 aa, Artificial Sequence; identical to SEQ ID NO: 6800
  Synthetic Polypeptide encoding a CAR with optional accessory module(s)

SEQ ID NO: 6916 - protein, 1100 aa, Artificial Sequence
  Synthetic Polypeptide encoding a CAR with optional accessory module(s)
MALPVTALLLPLALLLHAARPDQSVLTQPPSVSGAPGQRVTISCTGSSSNIGAGYDVHWYQQLPGTAPKLLIYGNSNRPSGVPDRFSGSKSGTSASLAITGLQAEDEADYYCQSYDNSLSSWVFGGGTKLTVLGQPKGGGGSGGGGSGGGGSEVQLQQSGAEVKKPGSSVKVSCKASGGTFSSYAISWVRQAPGQGLEWMGRIIPILGIANYAQKFQGRVTITADKSTSTAYMELSSLRSEDTAVYYCARDVGSGSYSLDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6917 - protein, 1097 aa, Artificial Sequence
  Synthetic Polypeptide encoding a CAR with optional accessory module(s)
MALPVTALLLPLALLLHAARPDQSVVTQPPSVSAAPGRKVTISCSGSSSNIGSNYVSWYQQVPGTAPKLLIYEDDKRPSGIPDRFSGSKSGTSATLGITGLQTGDEADYFCATWDRTVNVVRFGGGTRLTVHSQPKGGGGSGGGGSGGGGSQLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARHVGHELDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6918 - protein, 1091 aa, Artificial Sequence
  Synthetic Polypeptide encoding a CAR with optional accessory module(s)
MALPVTALLLPLALLLHAARPDIQMTQSPSSLSASVGDRVTITCRASQSISSYLNWYQQKPGKAPKLLIYAASSLQSGVPSGFSGSGSGTDFTLTISSLQPEDFATYYCQQSYSTPLTFGGGTKVEIKRGGGGSGGGGSGGGGSQVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCAREGKNGAFDIWGQGTMVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6919 - protein, 977 aa, Artificial Sequence
  Synthetic Polypeptide encoding a CAR with optional accessory module(s)
MALPVTALLLPLALLLHAARPDEFDVQLVESGGGLVQPGGSLRLSCAASGFILDYYAIGWFRQAPGKEREGVLCIDASDDITYYADSVKGRFTISRDNSKNTVYLQMNSLRPEDTAVYYCATPIGLSSSCLLEYDYDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6920 - protein, 1140 aa, Artificial Sequence
  Synthetic Polypeptide encoding a CAR with optional accessory module(s)
MALPVTALLLPLALLLHAARPDEFDVQLVESGGGLVQPGGSLRLSCAASGFILDYYAIGWFRQAPGKEREGVLCIDASDDITYYADSVKGRFTISRDNSKNTVYLQMNSLRPEDTAVYYCATPIGLSSSCLLEYDYDYWGQGTLVTVSSLEGGSGSGGGGSGGGGSGSGGSGSGGSGSGGSGSGGSFEVQLVESGGGLVQPGGSLRLSCAASGRTYYLNAMGWFRQAPGKEREFVAAIDWSEGNKDYADSVKGRFTISRDNSKNTVYLQMNSLRPEDTAVYYCAADTPPWGPLIYIESYDSWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6921 - protein, 1091 aa, Artificial Sequence
  Synthetic Polypeptide encoding a CAR with optional accessory module(s)
MALPVTALLLPLALLLHAARPDQIVLTQSPAIMSASPGEKVTISCSASSSVSYMYWYQQKPGSSPKPWIYRTSNLASGVPARFSGSGSGTSYSLTISNMEAEDAAAYYCQQYHSYPTTFGGGTKLEVKGGGGSGGGGSGGGGSEVQLVESGGGLVQPKGSLKLSCAASGFSFNTYAMNWVRQAPGKGLEWIAHIRSKSNNFATYYADSVKDRFSISRDASENILFLQMNNLKTEDTAMYYCVRQGGDFPMDYWGQGTSVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6922 - protein, 1090 aa, Artificial Sequence
  Synthetic Polypeptide encoding a CAR with optional accessory module(s)
MALPVTALLLPLALLLHAARPDDIQMTQSSSSFSVSLGDRVTITCMASEDIYIRLAWYQQKPGNAPRLLISAATSLETGVPSRFSGSGSGKDYTLSITSLQTEDVGTYYCQQYWSSPWTFGGGTKLEINGGGGSGGGGSGGGGSDVQLQESGPGLVKPSQSLSLTCTVTGYSITSDYTWNWIRQFPGNKLEWMGYITYSGSTSYNPSLKSRNSITRDTSKNQFFLQLNSVTTEDTATYYCARLGRRYTMDYWGQGTSVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6923 - protein, 1089 aa, Artificial Sequence
  Synthetic Polypeptide encoding a CAR with optional accessory module(s)
MALPVTALLLPLALLLHAARPDVQLQESGPGLVKPSQSLSLTCTVTGYSITSDYTWNWIRQFPGNKLEWMGYITYSGSTSYNPSLKSRNSITRDTSKNQFFLQLNSVTTEDTATYYCARLGRRYTMDYWGQGTSVTVSSGGGGSGGGGSGGGGSDIQMTQSSSSFSVSLGDRVTITCMASEDIYIRLAWYQQKPGNAPRLLISAATSLETGVPSRFSGSGSGKDYTLSITSLQTEDVGTYYCQQYWSSPWTFGGGTKLEINTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6924 - protein, 1090 aa, Artificial Sequence
  Synthetic Polypeptide encoding a CAR with optional accessory module(s)
MALPVTALLLPLALLLHAARPDIQMTQSSSSFSVSLGDRVTITCKASEDIYIRLAWYQQKPGNAPRLLISAATSLETGIPSRFSGSGSGEDYTLTITSLQTEDVATYYCQQYWTTPWTFGGGTKLEIKRGGGGSGGGGSGGGGSDVQLQESGPGLVKPSQSLSLTCTVTGYSITIDYTWNWIRQFPGNKLEWMGYITYSGSTDYNPSLKSRSSITRDTSMNQFFLQLNSVTTEDTATYYCARLGRRYALDYWGQGTSVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6925 - protein, 1091 aa, Artificial Sequence
  Synthetic Polypeptide encoding a CAR with optional accessory module(s)
MALPVTALLLPLALLLHAARPDIVMTQAAPSIPVTPGESVSISCRSDKSLLHSNGNTYLFWFLQRPGQSPQLLIYRMSNLASGVPDRFSGSGSGTAFTLRISGVEAEDVGVYYCMQHLEYPYTFGGGTKLEIKGGGGSGGGGSGGGGSQVQLQQSGPELVKPGASVKMSCKASGYAFSSSWLNWVRQRPGKGLEWIGRIYPGDGENHYNGKFKGKATLTADKSSSTGYMQLSSLTSEDSAVYFCASYYEGGYWGQGTLITVSATRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6926 - protein, 1090 aa, Artificial Sequence
  Synthetic Polypeptide encoding a CAR with optional accessory module(s)
MALPVTALLLPLALLLHAARPDIVLTQSPASLAVSLGQSVTISCRASESVEYYGTSLMQWYQQKPGQPPKLLIYGASNVESGVPARFSGSGSGTDFSLNIHPVEEDDIAMYFCQQSRKVPWTFGGGTKLEIKGGGGSGGGGSGGGGSEVKLVESGGGLVKPGGSRKLSCAASGFTFSSYTMSWVRQTPAKRLEWVATISSGSSTIYYADTVKGRFTISRDNAKNTLFLQMTSLRSEDTAMYYCARRWFLDCWGQGTTLTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6927 - protein, 1093 aa, Artificial Sequence
  Synthetic Polypeptide encoding a CAR with optional accessory module(s)
MALPVTALLLPLALLLHAARPDQVQLQQSGPGLVKPSETLSLTCTVSGDSISSYYWSWIRQPPGKGLEWIGYIYYSGSTNYNPSLKSRVTISVDTSKSQFSLKLSSVTAADTAVYYCARGRYFDVWGRGTMVTSSGGGGSGGGGSGGGGSSSYVLTQPPSVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLGAAATRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6928 - protein, 1094 aa, Artificial Sequence
  Synthetic Polypeptide encoding a CAR with optional accessory module(s)
MALPVTALLLPLALLLHAARPDIVMTQSPLSLPVTPGEPASISCRSSKSLLHSNGNTYLYWFQQKPGQAPRLLIYRMSNLASGVPDRFSGSGSGTAFTLKISRVEAEDVGVYYCMQHIEYPFTFGQGTKLEIKGGGGSGGGGSGGGGSQVQLVQSGPEVKKPGASVKVSCKASGYTFTNSWMNWVRQRPGKGLEWIGRIYPGDGETIYNGKFRVRVTITADESTSTAYMELSSLRSEDTAVYYCARGYDDYSFAYWGQGTTVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6929 - protein, 1094 aa, Artificial Sequence
  Synthetic Polypeptide encoding a CAR with optional accessory module(s)
MALPVTALLLPLALLLHAARPDEIVMTQSPATLSLSPGERATLSCRASQSVSSYLAWYQQKPGQAPRLLIYDASNRATGIPARFSGSGSGTDFTLTISSLEPEDFAVYYCHQYGSSPQTFGQGTKVEIKRGGGGSGGGGSGGGGSEVQLVQSGAEVKKPGSSVKVSCKASGGTFSSYAISWVRQAPGQGLEWMGGIIPIFGTANYAQKFQGRVTITADESTSTAYMELSSLRSEDTAVYYCAVHYGDYVFSSMDVWGQGTTVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6930 - protein, 1097 aa, Artificial Sequence
  Synthetic Polypeptide encoding a CAR with optional accessory module(s)
MALPVTALLLPLALLLHAARPDETTLTQSPGTLSLSPGERATLSCRASQSVSSSYLAWYQQKPGQAPRLLIYGASSRATGIPDRFSGSGSGTDFTLTISRLEPEDFAVYYCQQYGSSPRTFGQGTKVEIKRGGGGSGGGGSGGGGSEVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGPEYCINGVCSLDVWGQGTTVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6931 - protein, 1099 aa, Artificial Sequence
  Synthetic Polypeptide encoding a CAR with optional accessory module(s)
MALPVTALLLPLALLLHAARPDIELTQSPSSLAVSAGEKVTMSCKSSQSLLNSRTRKNQLAWYQQKPGQSPELLIYWASTRQSGVPDRFTGSGSGTDFTLTISSVQAEDLAVYYCQQSYNLLTFGPGTKLEVKRGGGGSGGGGSGGGGSVKLQESGGGFVKPGGSLKVSCAASGFTFSSYAMSWVRLSPEMRLEWVATISSAGGYIFYSDSVQGRFTISRDNAKNTLHLQMGSLRSGDTAMYYCARQGFGNYGDYYAMDYWGQGTTVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6932 - protein, 1098 aa, Artificial Sequence
  Synthetic Polypeptide encoding a CAR with optional accessory module(s)
MALPVTALLLPLALLLHAARPDIQMTQSPSSLSASVGDRVTITCRSSQNIVHSNGNTYLDWYQQTPGKAPKLLIYKVSNRFSGVPSRFSGSGSGTDFTFTISSLQPEDIATYYCFQYSHVPWTFGQGTKLQIGGGGSGGGGSGGGGSQVQLQQSGAEVKKPGSSVKVSCKASGYTFTNYYIYWVRQAPGQGLEWIGGINPTSGGSNFNEKFKTRVTITADESSTTAYMELSSLRSEDTAFYFCTRQGLWFDSDGRGFDFWGQGTTVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6933 - protein, 994 aa, Artificial Sequence
  Synthetic Polypeptide encoding a CAR with optional accessory module(s)
MALPVTALLLPLALLLHAARPLFNQEVQIPLTESYCGPCPKNWICYKNNCYQFFDESKNWYESQASCMSQNASLLKVYSKEDQDLLKLVKSYHWMGLVHIPTNGSWQWEDGSILSPNLLTIIEMQKGDCALYASSFKGYIENCSTPNTYICMQRTVGGGGSGGGGDTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6934 - protein, 1088 aa, Artificial Sequence
  Synthetic Polypeptide encoding a CAR with optional accessory module(s)
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIKRGGGGSGGGGSGGGGSQVHLQESGPGLVKPSETLSLTCTVSDDSISSYYWSWIRQPPGKGLEWIGHISYSGSANYNPSLKSRVTISVDTSKNQFSLKLSSVTAADTAVYYCANWDDAFNIWGQGTMVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6935 - protein, 1090 aa, Artificial Sequence
  Synthetic Polypeptide encoding a CAR with optional accessory module(s)
MALPVTALLLPLALLLHAARPDVVMTQTPLTLSVTIGQPASISCKSSQSLLDSDGKTYLHWLLQRPGQSPKRLIFLVSKLDSGVPDRFTGSGSGTDFTLKISRVEAEDLGVYYCWQGTHFPQTFGGGTKLEIKGGGGSGGGGSGGGGSVQLQESGPDLVKPSQSLSLTCTVTGYSITSGYSWHWIRQFPGNKLEWMGYIHYSGDTDYNPSLKSRFSITRDTSKNQFFLQLNSVTTEDTATYYCATPGGFVYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6936 - protein, 1094 aa, Artificial Sequence
  Synthetic Polypeptide encoding a CAR with optional accessory module(s)
MALPVTALLLPLALLLHAARPDQSELTQPRSVSGSPGQSVTISCTGTERDVGGYNYVSWYQQHPGKAPKLIIHDVIERSSGVPDRFSGSKSGNTASLTISGLQAEDEADYYCWSFAGGYYVFGTGTDVTVLGGGGSGGGGSGGGGSFEVQLLESGGGLVQPGGSLRLSCAASGFTFSTYQMSWVRQAPGKGLEWVSGIVSSGGSTAYADSVKGRFTISRDNSKNTLYLQMNSLRAEDTAVYYCAGELLPYYGMDVWGQGTTVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6937 - protein, 1093 aa, Artificial Sequence
  Synthetic Polypeptide encoding a CAR with optional accessory module(s)
MALPVTALLLPLALLLHAARPDQSELTQPRSVSGSPGQSVTISCTGTERDVGGYNYVSWYQQHPGKAPKLIIHDVIERSSGVPDRFSGSKSGNTASLTISGLQAEDEADYYCWSFAGGYYVFGTGTDVTVLGGGGSGGGGSGGGGSEVQLLESGGGLVQPGGSLRLSCAASGFTFSTYEMHWVRQAPGKGLEWVSVILSSGGETNYADSVKGRFTISRDNSKNTLYLQMNSLRAEDTAVYYCAGMLLPYYGMDVWGQGTTVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6938 - protein, 995 aa, Artificial Sequence
  Synthetic Polypeptide encoding a CAR with optional accessory module(s)
MALPVTALLLPLALLLHAARPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6939 - protein, 1090 aa, Artificial Sequence
  Synthetic Polypeptide encoding a CAR with optional accessory module(s)
MALPVTALLLPLALLLHAARPDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRGGGGSGGGGSGGGGSEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6940 - protein, 1091 aa, Artificial Sequence
  Synthetic Polypeptide encoding a CAR with optional accessory module(s)
MALPVTALLLPLALLLHAARPAIVMTQTPSPVSAAVGGTVTINCQASESVYSNNYLSWFQQKPGQPPKLLIYLASTLASGVPSRFKGSGSGTQFTLTISGVQCDDAATYYCIGGKSSSTDGNAFGGGTEVVVRGGGGSGGGGSGGGGSQSLEESGGRLVKPDETLTITCTVSGIDLSSNGLTWVRQAPGEGLEWIGTINKDASAYYASWAKGRLTISKPSSTKVDLKITSPTTEDTATYFCGRIAFKTGTSIWGPGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6941 - protein, 1089 aa, Artificial Sequence
  Synthetic Polypeptide encoding a CAR with optional accessory module(s)
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSGGGGSGGGGSQVQLVQSGAEVKKPGASVKVSCKASGYTFTSYDVHWVRQAPGQRLEWMGWLHADTGITKFSQKFQGRVTITRDTSASTAYMELSSLRSEDTAVYYCARERIQLWFDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6942 - protein, 1108 aa, Artificial Sequence
  Synthetic Polypeptide encoding a CAR with optional accessory module(s)
MALPVTALLLPLALLLHAARPDDIVMTQSPLSLPVTPGEPASISCRSSQSLLHSNGYNYLVWYLQKPGQSPQLLIYLGSIRASGVPDRFSGSGSGTDFTLKISRVEAEDVGVYYCMQPLQTPITFGQGTRLEIKRGGGGSGGGGSGGGGSGLQCVAAPRWVLSQVQLQQWGAGLLKPSETLSLTCAVYGGSFSGNYWSWIRQPPGKGLEWIGEINHSGSTNYNPSLKSRVTISVDTSKNQFSLKLSSVTAADTAVYYCARGGSYNYFDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6943 - protein, 1105 aa, Artificial Sequence
  Synthetic Polypeptide encoding a CAR with optional accessory module(s)
MALPVTALLLPLALLLHAARPDQLTQSPSSVSASVGDRVTITCRASRGISSWLAWYQQKPGKAPKLLIYTASSLQSGVPSRFSGSGSGTDFTLTISSLQPEDFATYYCQQAYSFPRTFGQGTKVEIKRGGGGSGGGGSGGGGSVAAPRWVLSQVQLQESGPGLVKPSQTLSLTCTVSGGSISSGGYYWIWIRQHPGKGLEWIGYIYYNGNTYYNPSLKSRVTMSVDTSKNQFSLKLSSVTAADTAVYYCARDGITMIRGYYYGMDVWGQGTTVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6944 - protein, 1079 aa, Artificial Sequence
  Synthetic Polypeptide encoding a CAR with optional accessory module(s)
MALPVTALLLPLALLLHAARPDIVVTQSPASLAVSLGQRATISYRASKSVSTSGYSYMHWNQQKPGQPPRLLIYLVSNLESGVPARFSGSGSGTDFTLNIHPVEEEDAATYYCQHIRELTRSEGGPSWKGGGGSGGGGSGGGGSEVKLEESGGDLVKPGGSLKLSCAASGFTFSGYGMSWVRQTPDKRLEWVATISSGGSYTYYPDSVKGRFTISRDNAKNTLYLQMSSLKSEDTAMYYCARHEGGYYGSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6945 - protein, 1095 aa, Artificial Sequence
  Synthetic Polypeptide encoding a CAR with optional accessory module(s)
MALPVTALLLPLALLLHAARPDDIQMTQSPSSLSASVGDRVTITCRASQGISNYLAWYQQKTGKVPKFLIYEASTLQSGVPSRFSGGGSGTDFTLTISSLQPEDVATYYCQNYNSAPFTFGPGTKVDIKGGGGSGGGGSGGGGSQVQLVESGGGVVQPGRSLRLSCAASGFAFSRYGMHWVRQAPGKGLEWVAVIWYDGSNKYYADSVKGRFTISRDNSKNTQYLQMNSLRAEDTAVYYCARGGDFLYYYYYGMDVWGQGTTVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6946 - protein, 1086 aa, Artificial Sequence
  Synthetic Polypeptide encoding a CAR with optional accessory module(s)
MALPVTALLLPLALLLHAARPDIQMTQSPSSLSTSVGDRVTLTCKASQDVGTAVDWYQQKPGPSPKLLIYWASTRHTGIPSRFSGSGSGTDFTLTISSLQPEDFADYYCQQYNSYPLTFGPGTKVDIKGGGGSGGGGSGGGGSEVQLVQSGPEVKKPGATVKISCKTSGYTFTEYTIHWVKQAPGKGLEWIGNINPNNGGTTYNQKFEDKATLTVDKSTDTAYMELSSLRSEDTAVYYCAAGWNFDYWGQGTLLTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6947 - protein, 1087 aa, Artificial Sequence
  Synthetic Polypeptide encoding a CAR with optional accessory module(s)
MALPVTALLLPLALLLHAARPDIQMTQSPSSLSASVGDRVTITCKASQDIYPYLNWFQQKPGKAPKTLIYRTNRLLDGVPSRFSGSGSGTDFTFTISSLQPYYCLQYDEFPLTFGAGTKLEIKRGGGGSGGGGSGGGGSQITLKESGPTLVKPTQTLTLTCTFSGFSLSTSNMGVGWIRQPPGKALEWLAHIWWDDDKYYSPSLKSRLTITKDTSKNQVVLTMTNMDPVDTATYYCVRSNYGYAWFAYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6948 - protein, 1087 aa, Artificial Sequence
  Synthetic Polypeptide encoding a CAR with optional accessory module(s)
MALPVTALLLPLALLLHAARPDIVMTQSQKFMSTSVGDRVNVTCKASQNVGTNVVWYQQKTGQSPKALIHSASYRYSGVPDRFTGSGSGTDFTLTLSNVQSEDLAEYFCQHYNSFPYTFGGGTKLEIKRGGGGSGGGGSGGGGSQVQLQQSGAELVRPGVSVKISCKGSGYRFTDYPIHWVKQSHAKSLEWIGIISTYYGDVTNNPKFRGKATMTVDKSSTTAYMELARLTSEDSAIYYCARNDLFAYWGQGTLVTVSATRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6949 - protein, 1090 aa, Artificial Sequence
  Synthetic Polypeptide encoding a CAR with optional accessory module(s)
MALPVTALLLPLALLLHAARPDIKMTQSPSSMYASLGERVTITCKASPDINSYLSWFQQKPGKSPKTLIYRANRLVDGVPSRFSGGGSGQDYSLTINSLEYEDMGIYYCLQYDEFPYTFGGGTKLEMKGGGGSGGGGSGGGGSEVKLVESGGGLVKPGGSLKLSCAASGFTFSSYAMSWVRQIPEKRLEWVASISRGGTTYYPDSVKGRFTISRDNVRNILYLQMSSLRSEDTAMYYCGRYDYDGYYAMDYWGQGTSVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6950 - protein, 1093 aa, Artificial Sequence
  Synthetic Polypeptide encoding a CAR with optional accessory module(s)
MALPVTALLLPLALLLHAARPDDVVVTPVSCFLSCISGAEGHHLIQGQQKCQYIWLLYALEPTETRTATQTPHLSCIQPRIWGPCQVQWQWVWDRLHPQHPSCGGGGCCNLLLSAHGAYTFGGGTRLELKGGGGSGGGGSGGGGSEVKLQESGPELVKPGASVKMSCKASGYTFTSYVMHWVKQKPGQGLEWIGYINPYNDGTKYNEKFKGKATLTSDKSSSTAYMELSSLTSEDSAVYYCARWKIYYGNYEDYWGQGTPLTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6951 - protein, 1123 aa, Artificial Sequence
  Synthetic Polypeptide encoding a CAR with optional accessory module(s)
MALPVTALLLPLALLLHAARPDEFQVQLVQSGGGLVQPGGSLRLSCAASDFDFAAYEMSWVRQAPGQGLEWVAIISHDGIDKYYTDSVKGRFTISRDNSKNTLYLQMNTLRAEDTATYYCLRLGAVGQGTLVTVSSLEGGGGSGGGGSGGGGSGSGGSGSGGSGSGGSGSGGSFEQVQLVQSGGGLVQPGGSLRLSCAASDFAFDDYEMSWVRQAPGKALEWIGDINHSGTTIYNPSLKSRVTISRDNSKNTLYLQMNTLRAEDTAIYYCARPHYGDYSDAFDIWGQGTMVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6952 - protein, 1098 aa, Artificial Sequence
  Synthetic Polypeptide encoding a CAR with optional accessory module(s)
MALPVTALLLPLALLLHAARPEIVMTQSPATLSVSPGERATLSCRASQSVSSNLAWYQQKPGQAPRLLIYGASTRATGIPARFSGSGSGTDFTLTISSLQSVDSAVYYCQQYNNWPPYTFGQGTKLEIKGGGGSGGGGSGGGGSQVQLLESGGGVVQPGRSLRLSCAASGFTFSFYGMHWVRQAPGKGLEWVAAISYDGSNKYYADSVKGRFTISRDNSKNTLYLQMNSLRAEDTAVYYCAKRPNQFYCSDGRCYSIDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6953 - protein, 1094 aa, Artificial Sequence
  Synthetic Polypeptide encoding a CAR with optional accessory module(s)
MALPVTALLLPLALLLHAARPQSVLTQPPSASAGGTPGQRVTISCSGSSSNIGSNFVYWYQQLPGTAPKLLIYRNNQRPSGVPDRFSGSRSGTSASLAGLRSEDEADYYCAADSLGGHYVFGTGTKVLGGGGSGGGGSGGGGSQVQLVESGGGSVQPGRSLRLSCEASGFTFEAYAMHWVRQPPGKGLEWVSSINWNSGRIAYADSVKGRFTISRDNARNSLYLQMNSLRLEDTAFYYCAKDIRRFSTGGAEFEYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6954 - protein, 1089 aa, Artificial Sequence
  Synthetic Polypeptide encoding a CAR with optional accessory module(s)
MALPVTALLLPLALLLHAARPENVLTQSPAIMSASPGEKVTMTCSASSSVSYMHWYQQKSSTSPKLWIYDTSKLASGVPGRFSGSGSGNSYSLTISSMEAEDVATYYCFQGSGYPLTFGAGTKLELKGGGGSGGGGSGGGGSQVQLKESGPGLVAPSQSLSITCTVSGFSLSSQGVYWVRQPPGKGLEWLGAIWAGGSTNYNSALMSRLSISKDNSKSQVFLKMNSLQTDDTAMYYCARVDGYRGYNMDYWGQGTSVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6955 - protein, 1093 aa, Artificial Sequence
  Synthetic Polypeptide encoding a CAR with optional accessory module(s)
MALPVTALLLPLALLLHAARPDDIQMTQSPSSLSASVGDRVTITCRASQSISSYLNWYQQKPGKAPKLLIYDASNLETGVPSRFSGSGSGTDFTFTISSLQPEDIATYYCQQYDNLPLTFGGGTKVDIKRGGGGSGGGGSGGGGSQVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARAHNSSSWSFDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6956 - protein, 1102 aa, Artificial Sequence
  Synthetic Polypeptide encoding a CAR with optional accessory module(s)
MALPVTALLLPLALLLHAARPDDVVMTQSPLSLPVSLGDQASISCRSSQRLVHSNGNTYLHWYLQKPGQSPKLLIYRVSNRFPGVPDRFSGSGSGTDFTLKISRVEAEDLGIYFCSQSTHVPYTFGGGTKLEIKRGGGGSGGGGSGGGGSEVRLQQSGPDLIKPGASVKMSCKASGYTFTGYVMHWVKQRPGQGLEWIGFINPYNDDIQSNERFRGKATLTSDKSSTTAYMELSSLTSEDSAVYYCARGAGYNFDGAYRFFDFWGQGTTLTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6957 - protein, 1093 aa, Artificial Sequence
  Synthetic Polypeptide encoding a CAR with optional accessory module(s)
MALPVTALLLPLALLLHAARPDSYELTQPPSVSVSPGQTATISCSGDQLGGKYGHWYQKKPGQSPVLVLYQDRKRPAGIPERFSGSSSGNTITLTISGTQAVDEADYYCQAWDTNLGGVFGGGTKVTVLGQGGGGSGGGGSGGGGSQVQLVESGAEVKKPGASVKVSCKASGYTFTGYYMHWVRQAPGQGLEWMGRINPNSGGTNYAQKFQGRVTMTRDTSISTAYMELSRLRSDDTAVYYCASPRGRGSAFDIWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6958 - protein, 1096 aa, Artificial Sequence
  Synthetic Polypeptide encoding a CAR with optional accessory module(s)
MALPVTALLLPLALLLHAARPDNFMLTQPHSVSESPGKTVTISCTRSSGSIASKYVQWYQQRPGSSPTTVIYEDNQRPSGVPDRFSGSIDTSSNSASLTISGLRTEDEADYYCHSYDSNNHSVFGGGTKVTVLGQGGGGSGGGGSGGGGSEVQLVESGGGVVQPGGSLRLSCAASGFTFSSYAMSWVRQAPGKGLEWVSAISGSGGSTYYADSVKGRFSISRDNSKNTLYLQMNSLRAEDTAVYYCARTRSSGAFDIWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6959 - protein, 1091 aa, Artificial Sequence
  Synthetic Polypeptide encoding a CAR with optional accessory module(s)
MALPVTALLLPLALLLHAARPDIQMNQSPSSLSASLGDTITITCHASQNINVWLSWYQQKPGNIPKLLIYKASNLHTGVPSRFSGSGSGTGFTITISSLQPEDIATYYCQQGQSYPWTFGGGTKLEIKRGGGGSGGGGSGGGGSEVQLQQSGPELVKPGASVKISCKASGYSFTGYFMNWVKQSHGKSLEYIGRFNPYNGETLYNQKFKGKATLTVDKSSSTVHMELLSVTSEDSAVYYCGRSGNDDAMDYWGQGTSVTVSSATRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6960 - protein, 1092 aa, Artificial Sequence
  Synthetic Polypeptide encoding a CAR with optional accessory module(s)
MALPVTALLLPLALLLHAARPDDIQMTQSPSILSASVGDRVTITCRASQRFGDYLAWYQQKPGQAPKLLIYGASTLQSGVPSRFSGSGSGTEFTLTISGLQPEDFATYYCQQANSFPITFGKGTRLDIRRGGGGSGGGGSGGGGSQVQLVQSGAEVKKPGSSVKVSCKASGGTFSSYAISWVRQAPGQGLEWMGWINVGNGNAIYSQKFQGRVTITRDTSATTAYMELSSLRSEDTAVYYCARDGERAWDLDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6961 - protein, 1097 aa, Artificial Sequence
  Synthetic Polypeptide encoding a CAR with optional accessory module(s)
MALPVTALLLPLALLLHAARPDETTLTQSPGTLSLSPGERATLSCRASQSVSSSYLAWYQQKPGQAPRLLIYGASSRATGIPDRFSGSGSGTDFTLTISRLEPEDFAVYYCQQYGSSPYTFGQGTKLEIKRGGGGSGGGGSGGGGSQVQLVQSGGGVVQPGRSLRLSCAASGFTFSSYAMHWVRQAPGKGLEWVAVISYDGSNKYYADSVKGRFTISRDNSKNTLYLQMNSLRAEDTAVYYCARELRFLEWSSDAFDIWGQGTMVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6962 - protein, 1092 aa, Artificial Sequence
  Synthetic Polypeptide encoding a CAR with optional accessory module(s)
MALPVTALLLPLALLLHAARPEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKGGGGSGGGGSGGGGSQLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTMIRGVIDSWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6963 - protein, 1089 aa, Artificial Sequence
  Synthetic Polypeptide encoding a CAR with optional accessory module(s)
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSGGGGSGGGGSQVQLVQSGAEVRKPGSSVKVSCKASGGSFNNYPIFWVRQAPGQGFEWMGRIIPILGITAYAQKFQGRVTITADKSTSTAYMELNSLRSEDTAVYYCAGGDDLDAFDIWGQGTMVSVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6964 - protein, 1101 aa, Artificial Sequence
  Synthetic Polypeptide encoding a CAR with optional accessory module(s)
MALPVTALLLPLALLLHAARPDIVMTQTPLSLPVTPGEPASISCRSSRSLLDSDDGNTYLDWYLQKPGQSPQLLIYTLSYRASGVPDRFSGSGSGTDFTLKISRVEAEDVGVYYCMQRVEFPITFGQGTRLEIKRGGGGSGGGGSGGGGSQVQLVESGGGVVQPGRSLRLSCAASGFIFSRYGMHWVRQAPGKGLKWVAVIWYDGSNKLYADSVKGRFTISRDNSKNTLYLQMNSLRAEDTAVYYCARDYYDNSRHHWGFDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6965 - protein, 1091 aa, Artificial Sequence
  Synthetic Polypeptide encoding a CAR with optional accessory module(s)
MALPVTALLLPLALLLHAARPEIQMTQSPSSMSASLGDTITITCQATQDIFKNLNWYQQKPGKPPSLLIYYATELAEGVPSRFSGSGSGSDYSLTISNLESEDFAAYYCLQFFEFPFTFGSGTKLEMKGGGGSGGGGSGGGGSQVQLQQSGAELVRPGTSVKVSCKASGYVFTNYWIEWIKQRPGQGLEWIGVMNPGSGETTYNEKFKGKATLTADKSSSTAYMQLSSLTSVDSAVYFCARDHDRDYYAMDYWGQGTSVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6966 - protein, 1088 aa, Artificial Sequence
  Synthetic Polypeptide encoding a CAR with optional accessory module(s)
MALPVTALLLPLALLLHAARPDILLTQSPAILSVSPGERVSFSCRASQNIGTSIHWYQQRTNGSPRLLIKYASESVSGIPSRFSGSGSGTDFTLSINSVESEDIADYYCQHTNSWPTTFGGGTKLEIKRGGGGSGGGGSGGGGSQVQLQQSDAELVKPGASVKISCKASGYTFTDHAIHWVKQKPEQGLEWIGYFSPGNGDIKYNEKFKGKATLTADKSSSTAYMQLNSLTSEDSAVYFCKRSYGNYDYWGQGTTLTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6967 - protein, 1093 aa, Artificial Sequence
  Synthetic Polypeptide encoding a CAR with optional accessory module(s)
MALPVTALLLPLALLLHAARPDIVMTQSPDSLAVSLGERATINCKSSQSLLNSGDQKNYLTWYQQKPGQPPKLLIYWASTRESGVPDRFSGSGSGTDFTLTISSLQAEDVAVYYCQNDYSYPLTFGQGTKVEIKGGGGSGGGGSGGGGSQVQLVQSGAEVKKTGSSVKVSCKASGYTFTDHAIHVWRQAPGQALEWMGHFSPGNTDIKYNDKFKGRVTLTVDRSMSTAYMELSSLRSEDTAMYYCKTSTFFFDYWGQGTMVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6968 - protein, 1015 aa, Artificial Sequence
  Synthetic Polypeptide encoding a CAR with optional accessory module(s)
MELTELLLVVMLLLTARLTLSSPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQLPPQGRTTAHKDPNAIFLSFQHLLRGKVRFLMLVGGSTLCVRRAPPTTAVPSRTSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6969 - protein, 1092 aa, Artificial Sequence
  Synthetic Polypeptide encoding a CAR with optional accessory module(s)
MALPVTALLLPLALLLHAARPDIQMTQSPSSLSASVGDRVTITCKASQDVSIAVAWYQQKPGKAPKVLIYSASYRYTGVPDRFSGSGSGTDFTFTISSLQPEDIAVYYCQQHYITPLTFGGGTKVEIKGGGGSGGGGSGGGGSQIQLVQSGHEVKKPGASVKVSCKASGYTFTNYGMNWVRQAPGQGLEWMGWINTKTGEPTYAEEFKGRFVFSLETSASTAYLQISSLKAEDTAMYFCGRGGYGSSYWYFDVWGQGTTVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6970 - protein, 1094 aa, Artificial Sequence
  Synthetic Polypeptide encoding a CAR with optional accessory module(s)
MALPVTALLLPLALLLHAARPDIVMTQSPDSLAVSLGERATINCRASKSVSTSGYSYMHWYQQKPGQPPKLLIYLASNLESGVPDRFSGSGSGTDFTLTISSLQAEDVAVYYCQHSRELPYTFGQGTKLEIKGGGGSGGGGSGGGGSQVQLQESGPGLVKPSETLSLTCTVSGGSISSYGVHWIRQPPGKGLEWIGVIWTSGVTDYNSALMGRVTISVDTSKNQFSLKLSSVTAADTAVYYCARDGDYDRYTMDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6971 - protein, 1073 aa, Artificial Sequence
  Synthetic Polypeptide encoding a CAR with optional accessory module(s)
MTALFLMSMLFGLACGQAMSFCIPTEYTMHIERRECAYCLTINTTICAGYCMTRDINGKLFLPKYALSQDVCTYRDFIYRTVEIPGCPLHVAPYFSYPVALSCKCGKCNTDYSDCIHEAIKTNYCTKPQKSYLVGFSVGGGGSGGGGSGGGGSAPDVQDCPECTLQENPFFSQPGAPILQCMGCCFSRAYPTPLRSKKTMLVQKNVTSESTCCVAKSYNRVTVMGGFKVENHTACHCSTCYYHKSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6972 - protein, 1090 aa, Artificial Sequence
  Synthetic Polypeptide encoding a CAR with optional accessory module(s)
MALPVTALLLPLALLLHAARPQSVLTQPPSVSVSPGQTASITCSGDKLGDKYACWYQQKPGQSPVLVIYQDSKRPSGIPERFSGSNSGNTATLTISGTQAMDEADYYCQAWDSSTAVVFGGGTKLTVLGGGGSGGGGSGGGGSQVQLVQSGAEVKKPGQSLKISCKASGYSLTDNWIGWVRQKPGKGLEWMGIIYPGDSDTRYSPSFQGQVTISADKSINTAYLQWSSLKASDTAIYYCVGLDWNYNPLRYWGPGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6973 - protein, 1088 aa, Artificial Sequence
  Synthetic Polypeptide encoding a CAR with optional accessory module(s)
MALPVTALLLPLALLLHAARPDIVMTQSQKFMSTSVGDRVSIICKASQNVGTFVAWYQQKPGQSPKLLVYSASNRYTGVPDRFTGSGSGTDFTLTINNMQSEDLADYFCRQYSSYPYTFGGGTKLEIKGGGGSGGGGSGGGGSEVQLQQSGPELVKPGASMKISCKASGYSFSAYTMNWVKQSHGKNLEWIGLINPYNGGTNYNQEFEGKATLTVNKSSNTAFMELLSLTSDDSAVYYCARRDWDYFDYWGQGTTLTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6974 - protein, 1099 aa, Artificial Sequence
  Synthetic Polypeptide encoding a CAR with optional accessory module(s)
MALPVTALLLPLALLLHAARPAIQMTQSPSSLSASVGDRVTITCRASQSISNYLNWYQQKPGKAPKLLIYAASSLQSGVPSRFSGSGSGTDFTLTISSLQPEDFATYYCQQSYSSPSTTFGQGTKLEIKRGGGGSGGGGSGGGGSEVQLVESGGGLIQPGGSLRLSCAASGFTVSSNYMSWVRQAPGKGLEWVSVTYSGGSTSYADSVKGRFTISRDNSKNTLYLQMNSLRAEDTAVYYCARGGRYCSSISCYARSGCDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6975 - protein, 1094 aa, Artificial Sequence
  Synthetic Polypeptide encoding a CAR with optional accessory module(s)
MALPVTALLLPLALLLHAARPDIQMTQSPSSLSASVGDRVTITCRASQSIGTSLHWYQQKPGKAPKLLIKFASRLQSGVPSRFSGSGSGTDFTLTISSLQPEDFATYYCQQSPGFPPTFGQGTKLEIKRGGGGSGGGGSGGGGSQVQLVESGGGLVKPGGSLRLSCAASGFSITTSGYYWTWIRQFPGKGLEWMGYIGYNSKTYYNPALKSRITISRDNAKNSLYLQMNSLRAEDTAVYYCARSLYGGYKDAFDSWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6976 - protein, 1099 aa, Artificial Sequence
  Synthetic Polypeptide encoding a CAR with optional accessory module(s)
MALPVTALLLPLALLLHAARPDEIVLTQSPLSLPVTPGEPASISCRSSQSLLHSIGYNYLDWYLQKPGQSPQLLIYLGSNRASGVPDRFSGSGSGTDFTLKISRVEAEDVGVYYCMQALQTPLTFGGGTKVEIKRGGGGSGGGGSGGGGSEVQLVESGGGVVQPGRSLRLSCAASGFTFRSYGMHWVRQAPGKGLEWVAVISYDGSNKYYTDSVNGRFTISRDNSKNTLYLQMNSLRAEDTAVYYCARGGGYYETSGPDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6977 - protein, 1097 aa, Artificial Sequence
  Synthetic Polypeptide encoding a CAR with optional accessory module(s)
MALPVTALLLPLALLLHAARPDDVVMTQSPLSLPVTPGEPASISCRSSQSLLHSIGYNYLHWFLQKPGQSPQLLIYLGSNRASGVPDRFSGSGSGTDFTLKISRVEAEDVGVYYCMQALQTPPTFGQGTRLEIKRGGGGSGGGGSGGGGSQLQLQESGPGLVKPSGTLSLTCAVSGGSISSSNWWSWVRQPPGKGLEWIGEIYHSGSTNYNPSLKSRVTISVDKSKNQFSLKLSSVTAADTAVYYCVGSPYGDYVLDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6978 - protein, 1100 aa, Artificial Sequence
  Synthetic Polypeptide encoding a CAR with optional accessory module(s)
MALPVTALLLPLALLLHAARPDVVMTQSPLSLPVTPGEPASISCRSSQSLLHSNGHNYLDWYLQKPGQSPQLLIYLGSNRASGVPDRFSGSGSGTDFTLKISRVEAEDVGVYYCMQTLQTPLTFGPGTKVDIKRGGGGSGGGGSGGGGSEVQLVETGGGVVQPGRSLRLSCAASGFTFSSYGMHWVRQAPGKGLEWVAVISYDGSNKYYADSVKGRFTISRDNSKNTLYLQMNSLRAEDTAVYYCAKDRYGWGSSFGHFDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6979 - protein, 1095 aa, Artificial Sequence
  Synthetic Polypeptide encoding a CAR with optional accessory module(s)
MALPVTALLLPLALLLHAARPDEIVLTQSPGTLSLSLGERATLSCRASQSISSSFLAWYQQKPGQAPKLLIYAASTRATGIPDRFSGSGSGTDFTLTISRLEPEDFAVYYCQQYGRSLSFGGGTKVEVKGGGGSGGGGSGGGGSQVQLQQSGPGLVKPSQTLSLTCAISGDSVSGNSATWNWIRQSPSRGLEWLGRTYYRSKWNHDYAESVKSRITINPDTSKNQFSLQLNSVTPEDTAVYYCARGDSSSWYAFDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6980 - protein, 1095 aa, Artificial Sequence
  Synthetic Polypeptide encoding a CAR with optional accessory module(s)
MALPVTALLLPLALLLHAARPDQTVVTQPPSASGTPGQRVTISCSGSSSNIGSNYVYWYQQLPGTAPKLLIYRSNQRPSGVPDRFSGSKSGTSASLAISGPRSVDEADYYCAAWDDSLNGVVFGGGTKLTVLGGGGGSGGGGSGGGGSQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARRIPPYYGMDVWGQGTTVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6981 - protein, 1095 aa, Artificial Sequence
  Synthetic Polypeptide encoding a CAR with optional accessory module(s)
MALPVTALLLPLALLLHAARPDQSVVTQPPSVSVAPGKTARITCGRNNIGSKSVHWYQQKPGQAPVLVVYDDSDRPSGIPERFSGSNSGNTATLTISRVEAGDEADYYCQVWDSSSDHVVFGGGTKLTVLGGGGGSGGGGSGGGGSEVQLVQSGGGVVRPGGSLRLSCAASGFTFDDYGMSWVRQAPGKGLEWVSGINWNGGSTGYADSVRGRFTISRDNAKNSLYLQMNSLRAEDTALYYCARERGYGYHDPHDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6982 - protein, 1107 aa, Artificial Sequence
  Synthetic Polypeptide encoding a CAR with optional accessory module(s)
MALPVTALLLPLALLLHAARPEQKLISEEDLEFQAVVTQPPSASGTPGQRVTISCSGSSSNIGSNTVNWYQQVPGTAPKLLIYSNNQRPSGVPDRFSGSKSGTSASLAISGLQSEDEADYYCAAWDDSLNGWVFGGGTKLTVLGGGGSGGGGSGGGGSQMQLVQSGAEVKEPGESLRISCKGSGYSFTNFWISWVRQMPGKGLEWMGRVDPGYSYSTYSPSFQGHVTISADKSTSTAYLQWNSLKASDTAMYYCARVQYSGYYDWFDPWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6983 - protein, 1101 aa, Artificial Sequence
  Synthetic Polypeptide encoding a CAR with optional accessory module(s)
MALPVTALLLPLALLLHAARPEQKLISEEDLEFDIQMTQSPSTLSASVGDRVTITCRASQNINKWLAWYQQRPGKAPQLLIYKASSLESGVPSRFSGSGSGTEYTLTISSLQPDDFATYYCQQYNSYATFGQGTKVEIKRGGGGSGGGGSGGGGSQVQLVQSGAEVKKPGESLKISCKGSGYNFSNKWIGWVRQLPGRGLEWIAIIYPGYSDITYSPSFQGRVTISADTSINTAYLHWHSLKASDTAMYYCVRHTALAGFDYWGLGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6984 - protein, 1091 aa, Artificial Sequence
  Synthetic Polypeptide encoding a CAR with optional accessory module(s)
MALPVTALLLPLALLLHAARPEIVLTQSPGTLSLSPGERATLSCRASQSVSNTYLAWYHQRPGQAPRLLIYGASSRATGIPDRFSGSGSGTDFALTISSLEPEDFAVYYCQQYSNSWTFGQGTKVEIKRGGGGSGGGGSGGGGSQVQLVESGGGVVQPGRSLRLSCAASGFTFSSYDMHWVRQAPGKGLEWVAVISYDGTNEYYADSVKGRFTISRDTSKNTLYLQMNSLRAEDTAVYYCARERYFDWSFDYWGQGTLVSVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6985 - protein, 1090 aa, Artificial Sequence
  Synthetic Polypeptide encoding a CAR with optional accessory module(s)
MALPVTALLLPLALLLHAARPELTQDPAVSVALGQTVRITCQGDSLRSNYANWYQQKPGQAPVLVIYGQNNRPSGIPDRFSGSSSGNTASLTITGAQAADEADYYCDSRVSTGNHVVFGGGTKLTVLGQGGGGSGGGGSGGGGSEVQLVQSGAEVKKPGASVKVSCKASGYTFTSYAMHWVRQAPGQRLEWMGWINAGNGNTKYSQKFQGRVTITRDTSASTAYMELSSLRSEDTAVYYCARDISYGSFDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6986 - protein, 1092 aa, Artificial Sequence
  Synthetic Polypeptide encoding a CAR with optional accessory module(s)
MALPVTALLLPLALLLHAARPDIVLTQTPATLSVTPGDSVSLSCRASQSISNNLHWYQQKSHESPRLLIKNASQSISGIPSKFSGSGSGTDFTLRINSVETEDFGMYFCQQSNSWPYTFGSGTKLEIKGGGGSGGGGSGGGGSQVKLQQSGPELVKPGASVKISCKASGYSFTGYYMHWVKQSHGNILDWIGYIYPYNGVSSYNQKFKGKATLTVDKSSSTAYMELRSLTSEDSAVYYCARERGLYQLRAMDYWGQGTSVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6987 - protein, 1083 aa, Artificial Sequence
  Synthetic Polypeptide encoding a CAR with optional accessory module(s)
MALPVTALLLPLALLLHAARPDIVMTQTPAIMSASPGQKVTITCSASSSVNYMHWYQQKLGSSPKLWIYDTSKLAPGVPARFSGSGSGTSYSLTISSMEAEDAASYFCHQWSSYPYTFGSGTKLEIKGGGGSGGGGSGGGGSEVQLQESGPDLVKPSQSLSLTCTVTGYSITSGYGWHWIRQFPGNKLEWMGYIHYSGSTTYNPSLKSRISISRDTSKNQFFLQLNSVTTEDTATYYCARSLRYWGQGTTLTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6988 - protein, 1086 aa, Artificial Sequence
  Synthetic Polypeptide encoding a CAR with optional accessory module(s)
MALPVTALLLPLALLLHAARPDIQMTQSPSSLSASVGDRVTITCSATSSISYMHWYQQKPGKAPKGWIYDTSKLAHGVPSRFSGSGSGTDFTLTISSLQPEDFATYYCHQRRSYPFTFGQGTKVEIKGGGGSGGGGSGGGGSEVQLVQSGAEVKKPGASVKVSCKASGYTFTNFWIHWVRQAPGQGLEWIGEIDPSDSYTNYNQKFKGRVTITRDTSTSTAYLELSSLRSEDTAVYYCAREITTVDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6989 - protein, 1093 aa, Artificial Sequence
  Synthetic Polypeptide encoding a CAR with optional accessory module(s)
MALPVTALLLPLALLLHAARPDIQMTQSPSSLSASVGDRVTITCKASQGFNKYVAWYQQKPGKAPKLLIYYTSTLQPGVPSRFSGSGSGRDYTLTISSLQPEDFATYYCLQYGNLLYAFGQGTKVEIKRGGGGSGGGGSGGGGSEVQLVQSGAEVKKPGASVKVSCKASGYTFTSYWIGWVRQAPGQGLEWIGDIYPGGGYTNYNEKFKGRVTITRDTSTSTAYLELSSLRSEDTAVYYCARLDGSSYRGAMDSWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6990 - protein, 1097 aa, Artificial Sequence
  Synthetic Polypeptide encoding a CAR with optional accessory module(s)
MALPVTALLLPLALLLHAARPDIQLTQSPSSLSASVGDRVTITCRASQSVDYDGDSYMNWYQQKPGKAPKLLIYAASYLESGVPSRFSGSGSGTDFTLTISSLQPEDFATYYCQQSHEDPYTFGQGTKVEIKRGGGGSGGGGSGGGGSEVQLVESGGGLVQPGGSLRLSCAVSGYSITSGYSWNWIRQAPGKGLEWVASITYDGSTNYNPSVKGRITISRDDSKNTFYLQMNSLRAEDTAVYYCARGSHYFGHWHFAVWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6991 - protein, 1089 aa, Artificial Sequence
  Synthetic Polypeptide encoding a CAR with optional accessory module(s)
MALPVTALLLPLALLLHAARPDIQMTQSPSSLSASVGDRVTITCRASQDIRYYLNWYQQKPGKAPKLLIYVASSLQSGVPSRFSGSGSGTEFTLTVSSLQPEDFATYYCLQVYSTPRTFGQGTKVEIKGGGGSGGGGSGGGGSEVQLVESGGGLAKPGGSLRLSCAASGFRFTFNNYYMDWVRQAPGQGLEWVSRISSSGDPTWYADSVKGRFTISRENAKNTLFLQMNSLRAEDTAVYYCASLTTGSDSWGQGVLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6992 - protein, 1090 aa, Artificial Sequence
  Synthetic Polypeptide encoding a CAR with optional accessory module(s)
MALPVTALLLPLALLLHAARPEIVMTQSPATLSVSPGERATLSCRASQSVSRNLAWYQQKPGQAPRLLIYGASTRATGIPARFSGSGSGTEFTLTIGSLQSEDFAVYYCQQYKTWPRTFGQGTNVEIKGGGGSGGGGSGGGGSQVQLQQWGAGLLKPSETLSLTCAVFGGSFSGYYWSWIRQPPGKGLEWIGEINHRGNTNDNPSLKSRVTISVDTSKNQFALKLSSVTAADTAVYYCARERGYTYGNFDHWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6993 - protein, 1091 aa, Artificial Sequence
  Synthetic Polypeptide encoding a CAR with optional accessory module(s)
MALPVTALLLPLALLLHAARPEIVMTPSSATLSVSPGERATLSCRASQSVSRNLAWYQQKPGQAPRLLIYGASTRATGIPARFSGSGSGTEFTLTISSLQSEDFAVYYCHQYSNWMCSFGQGTKLEIKGGGGSGGGGSGGGGSEVQLLESGGGLVQPGGSLRLSCAASGFTFSRYAMNWVRQAPGKGLEWVSGISGSGGRTYYADSVKGRFTISRDNSKNTLYLQMNSLRAEDTAVYYCAKDRDFWSGPFDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6994 - protein, 1091 aa, Artificial Sequence; identical to SEQ ID NO: 6993
  Synthetic Polypeptide encoding a CAR with optional accessory module(s)

SEQ ID NO: 6995 - protein, 1093 aa, Artificial Sequence
  Synthetic Polypeptide encoding a CAR with optional accessory module(s)
MALPVTALLLPLALLLHAARPQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSELVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6996 - protein, 1094 aa, Artificial Sequence
  Synthetic Polypeptide encoding a CAR with optional accessory module(s)
MALPVTALLLPLALLLHAARPEVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDKGGGYYDFWSGSDYWGQGTLVTVSSGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCNSRDSSGWVFGGGTKLTVLTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6997 - protein, 1103 aa, Artificial Sequence
  Synthetic Polypeptide encoding a CAR with optional accessory module(s)
MALPVTALLLPLALLLHAARPEVQLQQSGPGLVKPSQTLSLTCAISGDSVLSNSDTWNWIRQSPSRGLEWLGRTYHRSTWYDDYASSVRGRVSINVDTSKNQYSLQLNAVTPEDTGVYYCARDRLQDGNSWSDAFDVWGQGTMVTVSSGGGGSGGGGSGGGGSQSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLVYVFGTGTKVTVLTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6998 - protein, 1101 aa, Artificial Sequence
  Synthetic Polypeptide encoding a CAR with optional accessory module(s)
MALPVTALLLPLALLLHAARPQVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARGDSNYWSYYGMDVWGQGTLVTVSSGGGGSGGGGSGGGGSGGGGSQSVLTQPRSVSGSPGQSVTISCTGTSSDVGGYNYVSWYQQHPGEAPKLIIYDADKRPSGISNRFSSGKSGNTASLTISGLQVEDEADYYCCSYAGGSTWVFGGGTKVTVLTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6999 - protein, 1103 aa, Artificial Sequence
  Synthetic Polypeptide encoding a CAR with optional accessory module(s)
MALPVTALLLPLALLLHAARPEVQLQQSGPGLVKPSQTLSLTCAISGDSVSSNSAAWNWIRQSPSRGLEWLGRTYYRSKWYSDYAVSVKSRITINPDTSKNQFSLQLNSVTPEDTAVYYCARDPYDFWSGYPDAFDIWGQGTMVTVSSGGGGSGGGGSGGGGSQSALTQPASVSGSPGQSITISCTGTSSDVGGYNYVSWYQQHPGKAPKVIISEVNNRPSGVSHRFSGSKSGNTASLTISGLQAEDEADYFCSSYTSGRTLYVFGTGSKVTVLGTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 7000 - protein, 1102 aa, Artificial Sequence
  Synthetic Polypeptide encoding a CAR with optional accessory module(s)
MALPVTALLLPLALLLHAARPEVQLQQSGPGLVKPSQTLSLTCAISGDSMLSNSDTWNWIRQSPSRGLEWLGRTYHRSTWYDDYASSVRGRVSINVDTSKNQYSLQLNAVTPEDTGVYYCARVRLQDGNSWSDAFDVWGQGTMVTVSSGGGGSGGGGSGGGGSQSALTQPASASGSPGQSVTISCTGTSSDVGGYNYVSWYQQHPGKAPKLMIYDVSNRPSGVSNRFSGSKSGNTASLTISGLQAEDEADYYCSSYTSSSTLYVFGTGTQLTVLTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 7001 - protein, 1093 aa, Artificial Sequence; identical to SEQ ID NO: 6995
  Synthetic Polypeptide encoding a CAR with optional accessory module(s)

SEQ ID NO: 7002 - protein, 1102 aa, Artificial Sequence
  Synthetic Polypeptide encoding a CAR with optional accessory module(s)
MALPVTALLLPLALLLHAARPDVMLTQTPLSLPVSLGDQASISCRSSQSILHSTGDTYLEWYLQKPGQSPKLLINKVSNRLSGVPDRFSGSGSGTDFTLKISRVEAEDLGVYYCFQGSHVPWTFGGGTKLEIKRADAAPTVSIFPGGGGSGGGGSGGGGSQVKLQQSGPSLVKPGASVKMSCKASGYTFTDFYMKWVKQSHGKSLEWIGDINPNIGDTFYNQKFKGKATLTVDKSSSTAYMQLNSLTSEDSAVYFCSVGYFDVWGAGTTVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 7003 - protein, 1098 aa, Artificial Sequence
  Synthetic Polypeptide encoding a CAR with optional accessory module(s)
MALPVTALLLPLALLLHAARPEIVLTQSPATLSLSPGERATLSCRASQSVSIYLAWYQQKPGQAPRLLIYDASNRATGIPARFSGSGSGTDFTLTISSLEPEDFAVYYCQQRSNWPPFTFGPGTKVDIKGGGGSGGGGSGGGGSQVQLVESGGGVVQPGRSLRLSCAASGFTFSSYGMHWVRQAPGKGLEWVAVIWDDGSNKYYVDSVKGRFTISRDNSKNTLYLQMNSLRAEDTAVYYCARDDYYGSGSFNSYYGTDVWGQGTTVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 7004 - protein, 1083 aa, Artificial Sequence
  Synthetic Polypeptide encoding a CAR with optional accessory module(s)
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSGGGGSGGGGSEVQLVQSGGGLVHPGGSLRLSCAGSGFTFSTYLMYWVRQAPGKTLEWVSAIGSGGDTYYADSVKGRFTISRDNAKNSLYLQMNSLRAEDMAVYYCARGLGYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 7005 - protein, 1102 aa, Artificial Sequence
  Synthetic Polypeptide encoding a CAR with optional accessory module(s)
MALPVTALLLPLALLLHAARPLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGGGGSGGGGSGGGGSEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 7006 - protein, 1092 aa, Artificial Sequence
  Synthetic Polypeptide encoding a CAR with optional accessory module(s)
MALPVTALLLPLALLLHAARPQSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSVFGTGTKVLVLGGGGSGGGGSGGGGSQVQLVQSGAEVKKPGSSVKVSCKASGGTFSSYTINVWRQAPGQGLEWMGGFIPISGTVNYAQKFQGRVTITADESTSTAYMELSSLRSEDTAVYYCARPLDWTEDIWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 7007 - protein, 1095 aa, Artificial Sequence
  Synthetic Polypeptide encoding a CAR with optional accessory module(s)
MALPVTALLLPLALLLHAARPNFMLTQPHSVSESPGKTVTISCTGSSGSIASNYVQWYQQRPGSAPTILIYEDNKRPSGVPDRFSGSIDSSSNSASLTISGLKTGDEADYYCQSYDDINHWVFGGGTKLTVLGGGGGSGGGGSGGGGSEVQLVQSGAEVKKPGASVKVSCKASGYTFTAYYLHWLRQAPGQGLEWMGWMNTNNGATRYAQKFQDRVTMTRDTSINTAYMEMSGLSSDDTAMYYCARGDISQDFADVWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 7008 - protein, 1087 aa, Artificial Sequence
  Synthetic Polypeptide encoding a CAR with optional accessory module(s)
MALPVTALLLPLALLLHAARPQIVLTQSPAIMSASPGEKVTITCSASSSVSYMHWFQQKPGTSPKLWIYSTSNLASGVPARFSGSGSGTSYSLTISRMEAEDAATYYCQQRSSYPPTFGGGTKLEIKGGGGSGGGGSGGGGSQVQLQQSGAELMKPGASVKISCKATGYTFSSYWIEWVKQRPGHGLEWIGEILPGSGSTNYNEKFKGKATFTADTSSNTAYMQLSSLTSEDSAVYYCARYDYPWFAYWGQGTLVTVSATRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 7009 - protein, 1095 aa, Artificial Sequence
  Synthetic Polypeptide encoding a CAR with optional accessory module(s)
MALPVTALLLPLALLLHAARPDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPFTFGSGTKLEIKGGGGSGGGGSGGGGSQVQLQQPGAELVRPGASVKLSCKASGYTFTSYWINWVKQRPGQGLEWIGNIYPSDSYTNYNQKFKDKATLTVDKSSSTAYMQLSSPTSEDSAVYYCTRSWRGNSFDYWGQGTTLTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 7010 - protein, 1093 aa, Artificial Sequence
  Synthetic Polypeptide encoding a CAR with optional accessory module(s)
MALPVTALLLPLALLLHAARPDTQMTQSPSSVSASVGDRVTITCRTSQDISNYLNWYQQKPGKAPKLLIYNTSRLHSGVPSRFSGSGSGTDFTLTISSLQPEDFATYYCQQSNMFPYTFGQGTKLEIKGGGGSGGGGSGGGGSQVQLVQSGAEVKKPGASVKVSCKASGYTFNGYFMNWVRQAPGQGLERMGRINPNNGDSFYNQKFQGRVTMTRDTSTSTVYMELPSLRSEDTAVYYCAREGYYGGRGYALDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 7011 - protein, 1098 aa, Artificial Sequence
  Synthetic Polypeptide encoding a CAR with optional accessory module(s)
MALPVTALLLPLALLLHAARPDIVMTQSPSSLAMSVGQKVTMTCKSSQSLLNSSNQKNYLAWYQQKPGQSPKLLVYFASTRESGVPDRFIGSGSGTDFTLTISSVQAEDLADYFCHQHYSTPLTFGAGTKLELKGGGGSGGGGSGGGGSEVQLQQSGPDLVKPGASVKMSCKASGYTFTSYVMHWVKQKPGQGLEWIGYIYPYNDGTKYNEKFKGKATLTSDKSSSTAYMELSSLTSEDSAVYYCAREEYGNYVRYFDVWGAGTTVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 7012 - protein, 1092 aa, Artificial Sequence
  Synthetic Polypeptide encoding a CAR with optional accessory module(s)
MALPVTALLLPLALLLHAARPQSVVTQPPSVSAAPGQKVTISCSGSSSNIGNNYVSWYQQLPGTAPKLLIYDNNKRPSGIPDRFSASKSGTSATLGITGLQTRDEADYYCGTWDSSLSAWVFGGGTKLTVLGGGGGSGGGGSGGGGSQVQLVQSGAEVKKPGSSVKVSCKASGDTFSSYYISWVRQAPGQGLEWMGRIIPILGIANYAQKYQGRVTLSADKSTSTSYMELNSLSSEDTAVYYCALDWSYSIDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 7013 - protein, 1098 aa, Artificial Sequence
  Synthetic Polypeptide encoding a CAR with optional accessory module(s)
MALPVTALLLPLALLLHAARPEFEVKLVESGGGLVKFGGSLKLSCAASGFTLSSYYMSWVRQSPEKRLELVAVINSNGGSTYYPDTVKGRFTISRDNAKNTLYLQMSSLKSEDTALYYCARPFYYSNSPFAYWGQGTLVTVSAGGGGSGGGGSGGGGSDVLMTQTPLSLPVSLGDQASISCRSSQSIVHRTGNTYLEWYLQKPGQSPKLLIYKVSNRFSGVPDRFSGSGSGTDFTLKISRVGAEDLGVYYCFQGSHVPYTFGGGTKLEIKTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 7014 - protein, 1095 aa, Artificial Sequence
  Synthetic Polypeptide encoding a CAR with optional accessory module(s)
MALPVTALLLPLALLLHAARPELVMTQSPASLAVSLGQRATISCRASESVDSYGKSFMHWYQLKPGQPPKLLIYRASNLESGVPARFSGSGSRTDFTLTIDPVEADDAATYYCQQNNEDPWTFGGGTKLEIKGGGGSGGGGSGGGGSEVQLEQSGPELVKPGASVKMSCKASGYTFTNYYMKWVKQSHGKSLEWIGDLNPNNGDTFYNQKFKGKATLTVDKSSNTAYMQLNSLTSEDSAVYYCARTGRYEENAMDYWGQGTSVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 7015 - protein, 1089 aa, Artificial Sequence
  Synthetic Polypeptide encoding a CAR with optional accessory module(s)
MALPVTALLLPLALLLHAARPDVVMTQSPSSLSASVGDRVTITCMASEDIYIRLAWYQQKPGNAPKLLIYAATSLETGVPSRFSGSGSGTDFTLTISSLQPEDFATYYCQQYWSSPWTFGGGTKVEIKGGGGSGGGGSGGGGSQVQLQESGPGLVKPSQTLSLTCTVSGYSITSDYTWNWIRQPPGNGLEWIGYITYSGSTSYNPSLKSRVLISVDTSKNQVSLKLSSVTAADTAVYYCARLGRRYTMDYWGQGTTVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 7016 - protein, 1096 aa, Artificial Sequence
  Synthetic Polypeptide encoding a CAR with optional accessory module(s)
MALPVTALLLPLALLLHAARPDVLMTQTPVSLSVSLGDQASISCRSSQSIVHSTGNTYLEWYLQKPGQSPKLLIYKISNRFSGVPDRFSGSGSGTDFTLKISRVEAEDLGVYYCFQASHAPRTFGGGTKLEIKRGGGGSGGGGSGGGGSEVILVESGGGLVKPGGSLKLSCAASGFTFSSYTMSWVRQTPEKRLEWVATISSGGGNTYYPDSVKGRFTISRDNAKNNLYLQMSSLRSEDTALYYCARYYRYEAWFASWGQGTLVTVSATRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 7017 - protein, 966 aa, Artificial Sequence
  Synthetic Polypeptide encoding a CAR with optional accessory module(s)
MALPVTALLLPLALLLHAARPQVKLEESGGGLVQAGRSLRLSCAASEHTFSSHVMGWFRQAPGKERESVAVIGWRDISTSYADSVKGRFTISRDNAKKTLYLQMNSLKPEDTAVYYCAARRIDAADFDSWGQGTQVTVSSQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 7018 - protein, 965 aa, Artificial Sequence
  Synthetic Polypeptide encoding a CAR with optional accessory module(s)
MALPVTALLLPLALLLHAARPEVQLVESGGGLVQAGGSLRLSCAASGRTFTMGWFRQAPGKEREFVAAISLSPTLAYYAESVKGRFTISRDNAKNTVVLQMNSLKPEDTALYYCAADRKSVMSIRPDYWGQGTQVTVSSQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 7019 - protein, 1099 aa, Artificial Sequence
  Synthetic Polypeptide encoding a CAR with optional accessory module(s)
MALPVTALLLPLALLLHAARPQVKLEESGGGLVQAGRSLRLSCAASEHTFSSHVMGWFRQAPGKERESVAVIGWRDISTSYADSVKGRFTISRDNAKKTLYLQMNSLKPEDTAVYYCAARRIDAADFDSWGQGTQVTVSSGGGGSGGGGSGGGGSEVQLVESGGGLVQAGGSLRLSCAASGRTFTMGWFRQAPGKEREFVAAISLSPTLAYYAESVKGRFTISRDNAKNTVVLQMNSLKPEDTALYYCAADRKSVMSIRPDYWGQGTQVTVSSQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 7020 - protein, 963 aa, Artificial Sequence
  Synthetic Polypeptide encoding a CAR with optional accessory module(s)
MALPVTALLLPLALLLHAARPEVQLVESGGGLVQAGGSLRLSCIATGKVFSIYDMGWYRQAPGKQRELVAEITSSGTTHYDDFVSGRFTISRDNAKNTVYLQMNTLKAEDTAVYYCRANHVFGGSYWGQGTQVTVSSQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 7021 - protein, 969 aa, Artificial Sequence
  Synthetic Polypeptide encoding a CAR with optional accessory module(s)
MALPVTALLLPLALLLHAARPQVQLVESGGGLVQPGGSLRLSCEASGFTLDYYAIGWFRQAPGKEREGVICISRSDGSTYYADSVKGRFTISRDNAKKTVYLQMISLKPEDTAAYYCAAGADCSGYLRDYEFRGQGTQVTVSSQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 7022 - protein, 1092 aa, Artificial Sequence
  Synthetic Polypeptide encoding a CAR with optional accessory module(s)
MALPVTALLLPLALLLHAARPEVQLVESGGGLVQAGGSLRLSCIATGKVFSIYDMGWYRQAPGKQRELVAEITSSGTTHYDDFVSGRFTISRDNAKNTVYLQMNTLKAEDTAVYYCRANHVFGGSYWGQGTQVTVSSEVAALEKQVQLVESGGGLVQPGGSLRLSCEASGFTLDYYAIGWFRQAPGKEREGVICISRSDGSTYYADSVKGRFTISRDNAKKTVYLQMISLKPEDTAAYYCAAGADCSGYLRDYEFRGQGTQVTVSSQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 7023 - protein, 975 aa, Artificial Sequence
  Synthetic Polypeptide encoding a CAR with optional accessory module(s)
MALPVTALLLPLALLLHAARPQVKLEESGGRLVQPRGSLRLSCAGSGRTFSTYGMAWFRQAPGKEREFVASKASMNYSGRTYYADSVKGRFTIARDNAKNMVFLQMNNLKPEDTAVYYCAAGTGCSTYGCFDAQIIDYWGKGTLVTVSSQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 7024 - protein, 966 aa, Artificial Sequence
  Synthetic Polypeptide encoding a CAR with optional accessory module(s)
MALPVTALLLPLALLLHAARPQVKLEESGGGLVQPGESLRLSCSASGSIFKVFRVFAMSWYRQGPGKQRELVASISSGETTTYADSVKGRFTISRDNAKNTAYLQMDSLKPEDTAVYYCNADHTFTGDFWGQGTQVTVSSQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 7025 - protein, 1101 aa, Artificial Sequence
  Synthetic Polypeptide encoding a CAR with optional accessory module(s)
MALPVTALLLPLALLLHAARPQVKLEESGGRLVQPRGSLRLSCAGSGRTFSTYGMAWFRQAPGKEREFVASKASMNYSGRTYYADSVKGRFTIARDNAKNMVFLQMNNLKPEDTAVYYCAAGTGCSTYGCFDAQIIDYWGKGTLVTVSSEVAALEKQVKLEESGGGLVQPGESLRLSCSASGSIFKVFRVFAMSWYRQGPGKQRELVASISSGETTTYADSVKGRFTISRDNAKNTAYLQMDSLKPEDTAVYYCNADHTFTGDFWGQGTQVTVSSQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 7026 - protein, 964 aa, Artificial Sequence
  Synthetic Polypeptide encoding a CAR with optional accessory module(s)
MALPVTALLLPLALLLHAARPQVKLEESGGELVQPGGPLRLSCAASGNIFSINRMGWYRQAPGKQRAFVASITVRGITNYADSVKGRFTISVDKSKNTIYLQMNALKPEDTAVYYCNAVSSNRDPDYWGQGTQVTVSSQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 7027 - protein, 976 aa, Artificial Sequence
  Synthetic Polypeptide encoding a CAR with optional accessory module(s)
MALPVTALLLPLALLLHAARPPVQLVESGGGLVQAGDSLRLSCAASGRTFGIGTMGWFRQPPGKEREFVAAIRWSTGGTRYADSVKGRFTISRDNAKLTVDLQMDSLKPEDTAVYYCAADRLSLDLSGRYHYNPAVYDYWGQGTQVTVSSQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 7028 - protein, 1108 aa, Artificial Sequence
  Synthetic Polypeptide encoding a CAR with optional accessory module(s)
MALPVTALLLPLALLLHAARPQVKLEESGGELVQPGGPLRLSCAASGNIFSINRMGWYRQAPGKQRAFVASITVRGITNYADSVKGRFTISVDKSKNTIYLQMNALKPEDTAVYYCNAVSSNRDPDYWGQGTQVTVSSGGGGSGGGGSGGGGSPVQLVESGGGLVQAGDSLRLSCAASGRTFGIGTMGWFRQPPGKEREFVAAIRWSTGGTRYADSVKGRFTISRDNAKLTVDLQMDSLKPEDTAVYYCAADRLSLDLSGRYHYNPAVYDYWGQGTQVTVSSQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 7029 - protein, 966 aa, Artificial Sequence
  Synthetic Polypeptide encoding a CAR with optional accessory module(s)
MALPVTALLLPLALLLHAARPAVQLVESGGGLVQAGDSLRLTCTASGRAFSTYFMAWFRQAPGKEREFVAGIAWSGGSTAYADSVKGRFTISRDNAKNTVYLQMNSLKSEDTAVYYCASRGIEVEEFGAWGQGTQVTVSSQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 7030 - protein, 967 aa, Artificial Sequence
  Synthetic Polypeptide encoding a CAR with optional accessory module(s)
MALPVTALLLPLALLLHAARPQVQLVESGGGLVQAGGSLRLSCAASGGTLSKNTVAWFRQAPGKERGFVASITWDGRTTYYADSVKGRFTISRDNAKNTVYLQMNSLKPEDTAVYVCADLGKWPAGPADYWGQGTQVTVSSQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 7031 - protein, 1093 aa, Artificial Sequence
  Synthetic Polypeptide encoding a CAR with optional accessory module(s)
MALPVTALLLPLALLLHAARPAVQLVESGGGLVQAGDSLRLTCTASGRAFSTYFMAWFRQAPGKEREFVAGIAWSGGSTAYADSVKGRFTISRDNAKNTVYLQMNSLKSEDTAVYYCASRGIEVEEFGAWGQGTQVTVSSPGGGGSPQVQLVESGGGLVQAGGSLRLSCAASGGTLSKNTVAWFRQAPGKERGFVASITWDGRTTYYADSVKGRFTISRDNAKNTVYLQMNSLKPEDTAVYVCADLGKWPAGPADYWGQGTQVTVSSQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 7032 - protein, 1121 aa, Artificial Sequence
  Synthetic Polypeptide encoding a CAR with optional accessory module(s)
MALPVTALLLPLALLLHAARPAVQLVESGGGLVQAGDSLRLTCTASGRAFSTYFMAWFRQAPGKEREFVAGIAWSGGSTAYADSVKGRFTISRDNAKNTVYLQMNSLKSEDTAVYYCASRGIEVEEFGAWGQGTQVTVSSPGGGGSPQVQLVESGGGLVQAGGSLRLSCAASGGTLSKNTVAWFRQAPGKERGFVASITWDGRTTYYADSVKGRFTISRDNAKNTVYLQMNSLKPEDTAVYVCADLGKWPAGPADYWGQGTQVTVSSEVAALEKEVAALEKEVAALEKEVAALEKQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 7033 - protein, 1095 aa, Artificial Sequence
  Synthetic Polypeptide encoding a CAR with optional accessory module(s)
MALPVTALLLPLALLLHAARPEIVLTQSPATLSLSPGERATLSCSASSSVSYMYWYQQKPGQAPRLLIYRTSNLASGIPARFSGSGSGTDFTLTISSLEPEDFAVYYCQQYHSYPTTFGQGTKVEIKRTVGGGGSGGGGSGGGGSEVQLVESGGGLVQPGGSLRLSCAASGFSFNTYAMNWVRQAPGKGLEWVSHIRSKSNNFATYYADSVKDRFTISRDNAKNSLYLQMNSLRAEDTAVYYCARQGGDFPMDYWGQGTLVTVSSTRTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 7034 - protein, 1089 aa, Artificial Sequence
  Synthetic Polypeptide encoding a CAR with optional accessory module(s)
MALPVTALLLPLALLLHAARPDVVMTQSPSSLSASVGDRVTITCKASEDIYIRLAWYQQKPGKAPKLLIYAATSLETGVPSRFSGSGSGTDFTLTISSLQPEDFATYYCQQYWTTPWTFGGGTKVEIKGGGGSGGGGSGGGGSQVQLQESGPGLVKPSQTLSLTCTVSGYSITIDYTWNWIRQPPGKGLEWIGYITYSGSTDYNPSLKSRVLISVDTSKNQVSLKLSSVTAADTAVYYCARLGRRYALDYWGQGTTVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 7035 - protein, 1094 aa, Artificial Sequence
  Synthetic Polypeptide encoding a CAR with optional accessory module(s)
MALPVTALLLPLALLLHAARPDIQLTQSPSFLSASVGDRVTITCRASQGISTDLNWYQQKPGKAPKLLIYAASNLESGVPSRFSGSGSGTEFTLTISSLQPEDFATYYCQQSYNWPYTFGGGTKVEIKRGGGGSGGGGSGGGGSEVQLVESGGGLVKPGGSLRLSCAASGFTFSNFEMNWVRQAPGKGLEWVSGISSNGRYINYADSVKGRFTISRDNAKNSLYLQMNSLRAEDTAVYYCARVVDFDQDYNGFDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 7036 - protein, 1092 aa, Artificial Sequence
  Synthetic Polypeptide encoding a CAR with optional accessory module(s)
MALPVTALLLPLALLLHAARPDIQLTQSPSFLSASVGDRVTITCSLSLGISTWRDWFPPRLGRGLEPLTYAASTLQSGVPSRFSGSGSGTEFTLTISSLQPEDFATYYCQQLNSYPLTFGGGTKVEIKRGGGGSGGGGSGGGGSEVQLVESGGGLVKPGGSLRLSCAASGFTFSTYGMSWVRQAPGKGLEWVAYINNGSGYIYYADSVKGRFTISRDNAKNSLYLQMNSLRAEDTAVYYCARGQWWSGGDFDYWGQGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 7037 - protein, 1076 aa, Artificial Sequence
  Synthetic Polypeptide encoding a CAR with optional accessory module(s)
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7038 - protein, 1077 aa, Artificial Sequence
  Synthetic Polypeptide encoding a CAR with optional accessory module(s)
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7039 - protein, 1078 aa, Artificial Sequence
  Synthetic Polypeptide encoding a CAR with optional accessory module(s)
MALPVTALLLPLALLLHAARPDEIVLTQSPATLSLSPGERATLSCSASSSVSYMHWYQQKPGQAPRLLIYDTSKLASGIPARFSGSGSGTDFTLTISSLEPEDVAVYYCFQGSVYPFTFGQGTKLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTLSLTCTVSGGSISTSGMGVGWIRQHPGKGLEWIGHIWWDDDKRYNPALKSRVTISVDTSKNQFSLKLSSVTAADTAVYYCARMELWSYYFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7040 - protein, 1085 aa, Artificial Sequence
  Synthetic Polypeptide encoding a CAR with optional accessory module(s)
MALPVTALLLPLALLLHAARPDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7041 - protein, 1084 aa, Artificial Sequence
  Synthetic Polypeptide encoding a CAR with optional accessory module(s)
MALPVTALLLPLALLLHAARPDIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7042 - protein, 1076 aa, Artificial Sequence
  Synthetic Polypeptide encoding a CAR with optional accessory module(s)
MALPVTALLLPLALLLHAARPDYIHVTQSPSSLSVSIGDRVTINCQTSQGVGSDLHWYQHKPGRAPKLLIHHASSVEDGVPSRFSGTGFHTSFNLTINDLQADDIGTYYCQVLQSFGRGSRLDTKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFERAHLVQSGTAMKKPGASVRVSCQTSGYTFTAHILFWFRQAPGRGLEWVGWIKPQYGAVNFGGGFRDRVTLTRDVYREIAYMDIRGLKPDDTAVYYCARDRSYGDSSWALDAWGQGTTVVVSATRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7043 - protein, 1086 aa, Artificial Sequence
  Synthetic Polypeptide encoding a CAR with optional accessory module(s)
MALPVTALLLPLALLLHAARPDVQMIQTPDSLAVSLGQRATISCRASESVDNYGISFMHWYQQKPGQSPKLLIYRASNLESGIPARFSGSGSRTDFTLTINPVETDDVATYYCQQNNKDPPTFGGGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEGGGGSQVQLQQSGAELVKPGASVKISCKASGYAFSSYWMNWVKQRPGKGLEWIGQIYPGDGDTTYNGKFKGKATLTADKSSSTVYMQLNSLTSEDSAVYFCVRYYYGSSGYFDYWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7044 - protein, 1077 aa, Artificial Sequence
  Synthetic Polypeptide encoding a CAR with optional accessory module(s)
MALPVTALLLPLALLLHAARPDVQMIQTPSSLSASLGDRVTISCRASQDIGNYLNWYQQKPDGTVKLLIYYTSRLHSGVPSRFSGSGSGTEYSLTISNLEQEDIATYFCQQGSALPPTFGGGTKLEINLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEALQLQQSGAELVRPGASVTLSCKASGYTFTDYEMHWVKQTPVHGLEWIGAIDPETGGTAYNQKFEGKAILTADKSSSTAYMELRSLTSEDSPVYYCARRRYYGSSSFDYWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7045 - protein, 1084 aa, Artificial Sequence
  Synthetic Polypeptide encoding a CAR with optional accessory module(s)
MRLPAQLLGLLMLWVSGSSGDVVMTQSPLSLPVTPGAPASISCRSSQSIVHSNGNTYLEWYLQKPGQSPKLLIYKVSNRFSGVPDRFSGSGSGTDFTLRISRVEAEDVGIYYCFQGSHVPPTFGPGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCSASGFTFSSFGMHWVRQAPGKGLEWVAYISSGSSTIYYGDTVKGRFTISRDNAKNSLFLQMSSLRAEDTAVYYCAREGGYYYGRSYYTMDYWGQGTTVTVSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7046 - protein, 1398 aa, Artificial Sequence
  Synthetic Polypeptide encoding a CAR with optional accessory module(s)
MALPVTALLLPLALLLHAARPARKRTQPTFGFTVNWKFSESTTVFTGQCFIDRNGKEVLKTMWLLRSSVNDIGDDWKATRVGINIFTRLRTQKEGGSGGSARKCSLTGKWTNDLGSNMTIGAVNSRGEFTGTYITAVTATSNEIKESPLHGTQNTINKSGGSTTVFTGQCFIDRNGKEVLKTMWLLRSSVNDIGDDWKATRVGINIFTRLRTQKEGGSGGSARKCSLTGKWTNDLGSNMTIGAVNSRGEFTGTYITAVTATSNEIKESPLHGTQNTINKRTQPTFGFTVNWKFSELEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEARKRTQPTFGFTVNWKFSESTTVFTGQCFIDRNGKEVLKTMWLLRSSVNDIGDDWKATRVGINIFTRLRTQKEGGSGGSARKCSLTGKWTNDLGSNMTIGAVNSRGEFTGTYITAVTATSNEIKESPLHGTQNTINKSGGSTTVFTGQCFIDRNGKEVLKTMWLLRSSVNDIGDDWKATRVGINIFTRLRTQKEGGSGGSARKCSLTGKWTNDLGSNMTIGAVNSRGEFTGTYITAVTATSNEIKESPLHGTQNTINKRTQPTFGFTVNWKFSETRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7047 - protein, 1081 aa, Artificial Sequence
  Synthetic Polypeptide encoding a CAR with optional accessory module(s)
MALPVTALLLPLALLLHAARPDIVLTQSPASLAVSLGQRATISCRASKSVSTSGYSYLHWYQQKPGQPPKLLIYLASNLESGVPARFSGSGSGTDFTLNIHPVEEEDAATYYCQHSRELPFTFGSGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVESGGGLVQPGGSLKLSCAASGFDFSRYWMSWVRQAPGKGLEWIGEINPTSSTINFTPSLKDKVFISRDNAKNTLYLQMSKVRSEDTALYYCARGNYYRYGDAMDYWGQGTSVTVSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7048 - protein, 1079 aa, Artificial Sequence
  Synthetic Polypeptide encoding a CAR with optional accessory module(s)
MALPVTALLLPLALLLHAARPDIQMTQSPSSLSASVGDRVTITCSASQDISNYLNWYQQKPGKAPKLLIYYTSNLHSGVPSRFSGSGSGTDFTLTISSLQPEDFATYYCQQYRKLPWTFGQGTKLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKVSCKASGGTFSNYWMHWVRQAPGQGLEWMGATYRGHSDTYYNQKFKGRVTITADKSTSTAYMELSSLRSEDTAVYYCARGAIYDGYDVLDNWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7049 - protein, 1079 aa, Artificial Sequence
  Synthetic Polypeptide encoding a CAR with optional accessory module(s)
MALPVTALLLPLALLLHAARPDIVLTQSPATLSLSPGDRATISCRASESVTILGSHLIYWYQQKPGQPPRLLIQLASNVQTGVPARFSGSGSRTDFTLTISSVEPEDFAVYYCLQSRTIPRTFGQGTKLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGPEVKKPGESVKISCKASGYTFRHYSMNWVKQAPGQGLKWMGRINTESGVPIYADDFKGRFSFTVDTSASTAYLEISSLTSEDTAVYFCSNDYLYSLDFWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7050 - protein, 1078 aa, Artificial Sequence
  Synthetic Polypeptide encoding a CAR with optional accessory module(s)
MALPVTALLLPLALLLHAARPQSVLTQPPSVSGAPGQRVTISCTGSSSNIGAGFDVHWYQQLPGTAPKLLIYGNSNRPSGVPDRFSGSKSGTSASLAITGLQAEDEADYYCQSYDSSLSGYVFGTGTKVTVLGLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFTDYYMHWVRQAPGQRLEWMGWINPNSGGTNYAQKFQDRITVTRDTSSNTGYMELTRLRSDDTAVYYCARSPYSGVLDKWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7051 - protein, 1077 aa, Artificial Sequence
  Synthetic Polypeptide encoding a CAR with optional accessory module(s)
MALPVTALLLPLALLLHAARPQAVLTQPPSASGTPGQRVTISCSGSSSNIGSYTVSWYQQLPGTAPKFLIYSNNQRPSGVPDRFSGSKSGTSASLAISGLQSEDEADYYCAAWDDSLNGYVFGTGTKVTVLGLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEVQLVQSGAEVKKPGESLKISCKGSGYDFTTYWIGWVRQMPGKGLEWMGIIYPGDSDTRYSPSVRGRVTISADKSINTAYLQWSSLEASDTAMYYCARMWTFSQDGWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7052 - protein, 1080 aa, Artificial Sequence
  Synthetic Polypeptide encoding a CAR with optional accessory module(s)
MALPVTALLLPLALLLHAARPDIVMTQSPDSLAVSLGERATINCKSSQSILYSSNQKNYLAWYQQKPGQSPKLLIYWASTRESGVPDRFSGSGSGTDFTLTISSLQAEDVAVYYCHQYISSYTFGQGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFASQWMHWMRQAPGQGLEWIGWINPGNVNTKYNEKFKGRATLTVDTSTNTAYMELSSLRSEDTAVYYCARSTWYRPLDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7053 - protein, 1204 aa, Artificial Sequence
  Synthetic Polypeptide encoding a CAR with optional accessory module(s)
MVRGVPFRHLLLVLQLALLPAATQGKKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEIYQELTQLKAAVERLCHPCPWEWTFFQGNCYFMSNSQRNWHDSITACKEVGAQLVVIKSAEEQNFLQLQSSRSNRFTWMGLSDLNQEGTWQWVDGSPLLPSFKQYWNRGEPNNVGEEDCAEFSGNGWNDDKCNLAKFWICKKSAASCSRDEEQFLSPAPATPNPPPATRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7054 - protein, 1080 aa, Artificial Sequence
  Synthetic Polypeptide encoding a CAR with optional accessory module(s)
MALPVTALLLPLALLLHAARPDHIVLTQSPSSLSASLGDRVTISCRASQDISTYLNWYQQKPDGTVKLLIFYTSRLHAGVPSRFSGSGSGTHHSLTISNLEQEDIATYFCQQGNSLPFTFGSGTKLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLKESGPELEKPGASVKISCKASGYSFTAYSMNWVKQNNGMSLEWIGSIDPYYGDTKYAQKFKGKATLTVDKASSTAYLQLKSLTSEDSAVYYCARRMITTGDWYFDVWGAGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7055 - protein, 1080 aa, Artificial Sequence; identical to SEQ ID NO: 7054
  Synthetic Polypeptide encoding a CAR with optional accessory module(s)

SEQ ID NO: 7056 - protein, 1234 aa, Artificial Sequence
  Synthetic Polypeptide encoding a CAR with optional accessory module(s)
MALPVTALLLPLALLLHAARPGMRTEDLPKAVVFLEPQWYRVLEKDSVTLKCQGAYSPEDNSTQWFHNESLISSQASSYFIDAATVDDSGEYRCQTNLSTLSDPVQLEVHIGWLLLQAPRWVFKEEDPIHLRCHSWKNTALHKVTYLQNGKGRKYFHHNSDFYIPKATLKDSGSYFCRGLVGSKNVSSETVNITITQGLAVSTISSFFPPGYQLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMALPVTALLLPLALLLHAARPGMRTEDLPKAVVFLEPQWYRVLEKDSVTLKCQGAYSPEDNSTQWFHNESLISSQASSYFIDAATVDDSGEYRCQTNLSTLSDPVQLEVHIGWLLLQAPRWVFKEEDPIHLRCHSWKNTALHKVTYLQNGKGRKYFHHNSDFYIPKATLKDSGSYFCRGLVGSKNVSSETVNITITQGLAVSTISSFFPPGYQTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7057 - protein, 1157 aa, Artificial Sequence
  Synthetic Polypeptide encoding a CAR with optional accessory module(s)
MALPVTALLLPLALLLHAARPGMRTEDLPKAVVFLEPQWYRVLEKDSVTLKCQGAYSPEDNSTQWFHNESLISSQASSYFIDAATVDDSGEYRCQTNLSTLSDPVQLEVHIGWLLLQAPRWVFKEEDPIHLRCHSWKNTALHKVTYLQNGKGRKYFHHNSDFYIPKATLKDSGSYFCRGLVGSKNVSSETVNITITQGLAVSTISSFFPPGYQLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEVQLVESGGGLVQAGGSLRLSCAASGSIFSGNVMGWYRRQAPGKEREWVAAIASGGSIYYRDSVKGRFTISRDNAKNTVYLQMNSLKPEDTAVYYCNSHPPTLPYWGLGTQVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7058 - protein, 1080 aa, Artificial Sequence
  Synthetic Polypeptide encoding a CAR with optional accessory module(s)
MALPVTALLLPLALLLHAARPDEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7059 - protein, 1082 aa, Artificial Sequence
  Synthetic Polypeptide encoding a CAR with optional accessory module(s)
MALPVTALLLPLALLLHAARPDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7060 - protein, 1083 aa, Artificial Sequence
  Synthetic Polypeptide encoding a CAR with optional accessory module(s)
MALPVTALLLPLALLLHAARPDIQMTQSPSSLSASVGDRVTITCRSSQSIVHSVGNTFLEWYQQKPGKAPKLLIYKVSNRFSGVPSRFSGSGSGTDFTLTISSLQPEDFATYYCFQGSQFPYTFGQGTKVEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGYEFSRSWMNWVRQAPGKGLEWVGRIYPGDGDTNYSGKFKGRFTISADTSKNTAYLQMNSLRAEDTAVYYCARDGSSWDWYFDVWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7061 - protein, 1075 aa, Artificial Sequence
  Synthetic Polypeptide encoding a CAR with optional accessory module(s)
MALPVTALLLPLALLLHAARPDIVMTQSPSSLSASVGDRVTITCKASQSVTNDVAWYQQKPGKAPKLLIYYASNRYTGVPSRFSGSGSGTDFTLTISSLQPEDFATYYCQQDYRSPWTFGGGTKVEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLEESGGGVVRPGRSLRLSCAASGFTFSDYGVNWIRQAPGKGLEWVTIIWGDGRTDYNSALKSRFTVSRNNSNNTLSLQMNSLTTEDTAVYYCVRAPGNRAMEYWGQGVLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7062 - protein, 1081 aa, Artificial Sequence
  Synthetic Polypeptide encoding a CAR with optional accessory module(s)
MALPVTALLLPLALLLHAARPDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQIFGQGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7063 - protein, 1074 aa, Artificial Sequence
  Synthetic Polypeptide encoding a CAR with optional accessory module(s)
MALPVTALLLPLALLLHAARPDIQMTQSPATIENTSLSASVGDRVTITCRASQGISSWLTWYQQKPEKAPKSLIYAASSLQSGVPSRFSGSGSGTDFTLTISSLQPEDFATYYCQQYDSYPITFGQGTRLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLQQWGAGLLKPSETLSLTCAVYGGSFSAYYWSWIRQPPGKGLEWIGDINHGGGTNYNPSLKSRVTISVDTSKNQFSLKLNSVTAADTAVYYCASLTAYWGQGSLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7064 - protein, 1079 aa, Artificial Sequence
  Synthetic Polypeptide encoding a CAR with optional accessory module(s)
MALPVTALLLPLALLLHAARPDEIVLTQSPDSLAVSLGERATINCKASQSVDFDGDSYLNWYQQKPGQPPKVLIYAASTLQSGVPSRFSGSGSGTDFTLTINSLEAEDAATYYCQQSNEDPWTFGGGTKVEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKVSGYTFTDYYITWVRQAPGQALEWMGWIYPGSGNTKYSQKFQGRFVFSVDTSASTAYLQLSSLKAEDTAVYYCANYGNYWFAYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7065 - protein, 1076 aa, Artificial Sequence
  Synthetic Polypeptide encoding a CAR with optional accessory module(s)
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLVQSGGGLVHPGGSLRLSCAGSGFAFSSSTMHWIRQAPGKGLEWISLIGSGGGIYYGDSVKGRFTISRDNAKNSLYLQMNSLRAEDMAVYYCVRGYFDWVDYFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7066 - protein, 1086 aa, Artificial Sequence
  Synthetic Polypeptide encoding a CAR with optional accessory module(s)
MALPVTALLLPLALLLHAARPDDIVMTQSPDSLTVSLGERTTINCKSSQSVLDSSKNKNSLAWYQQKPGQPPKLLLSWASTRESGIPDRFSGSGSGTDFTLTIDSLQPEDSATYYCQQSAHFPITFGQGTRLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFTNYGMNWVKQAPGQGLKWMGWINTYTGEPTYADDFKGRVTMTSDTSTSTAYLELHNLRSDDTAVYYCARWSWSDGYYVYFDYWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7067 - protein, 1082 aa, Artificial Sequence
  Synthetic Polypeptide encoding a CAR with optional accessory module(s)
MALPVTALLLPLALLLHAARPDEIVLTQSPGSLAVSPGERVTMSCKSSQSVFFSSSQKNYLAWYQQIPGQSPRLLIYWASTRESGVPDRFTGSGSGTDFTLTISSVQPEDLAIYYCHQYLSSRTFGQGTKLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLQQPGAEVVKPGASVKMSCKASGYTFTSYYIHWIKQTPGQGLEWVGVIYPGNDDISYNQKFQGKATLTADKSSTTAYMQLSSLTSEDSAVYYCAREVRLRYFDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7068 - protein, 1086 aa, Artificial Sequence
  Synthetic Polypeptide encoding a CAR with optional accessory module(s)
MALPVTALLLPLALLLHAARPDVLLTQSPLSLPVTLGQPASISCRSSQTIVHSNGNTYLEWFQQRPGQSPRLLIYQVSNRFSGVPDRFSGSGSGTDFTLKISRVEAEDVGVYYCFQGSHVPRTFGGGTKVEIKRALEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQIQLVQSGSELKKPGASVKVSCKASGYTFTNYGMNWVRQAPGQGLKWMGWINTNTGEPKYAEEFKGRFALSLDTSVSTAYLQINSLKAEDTAVYFCARGYGNYARGAWLAYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7069 - protein, 1071 aa, Artificial Sequence
  Synthetic Polypeptide encoding a CAR with optional accessory module(s)
MALPVTALLLPLALLLHAARPDEIVLTQSPATLSLSPGERATLSCSASSSINYIYWLQQKPGQAPRILIYLTSNLASGVPARFSGSGSGTDFTLTISSLEPEDFAVYYCLQWSSNPLTFGGGTKVEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVKPGGSLRLSCAASGFTFSSYDMSWVRQAPGKGLEWVSTISSGGSYTYYLDSIKGRFTISRDNAKNSLYLQMNSLRAEDTAVYYCARQGLDYWGRGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7070 - protein, 1080 aa, Artificial Sequence
  Synthetic Polypeptide encoding a CAR with optional accessory module(s)
MALPVTALLLPLALLLHAARPDIVMTQSPDSLAVSLGERATINCRASKSVSTSGYSFMHWYQQKPGQPPKLLIYLASNLESGVPDRFSGSGSGTDFTLTISSLQAEDVAVYYCQHSREVPWTFGQGTKVEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFTNYGMNWVRQAPGQGLEWMGWINTYTGEPTYADAFKGRFAFSLDTSTSTAYLQINSLRSDDTAVYYCARDYGDYGMDYWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7071 - protein, 1076 aa, Artificial Sequence
  Synthetic Polypeptide encoding a CAR with optional accessory module(s)
MALPVTALLLPLALLLHAARPDIVMTQTPLTLSVTIGQPASISCKSSQSLLDSDGKTYLNWLLQRPGQSPERLIYLVSKLDSGVPDRFTGSGSGTDFTLKISRVEAEDLGVYCCWQGTHFPYTFGGGTKVEIKGLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLQQPGAELVRPGASVKLSCKASGYTFTSYWMNWVKQRPGQGLEWIGMIDPSDSETHYNHIFKDKATLTVDKSSSTAYLQLSSLTSEDSAVYYCARNLYLWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7072 - protein, 1084 aa, Artificial Sequence
  Synthetic Polypeptide encoding a CAR with optional accessory module(s)
MALPVTALLLPLALLLHAARPDIVMTQSPDSLAVSLGERATINCESSQSLLNSGNQKNYLTWYQQKPGQPPKPLIYWASTRESGVPDRFSGSGSGTDFTLTISSLQAEDVAVYYCQNDYSYPYTFGQGTKLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVKKPGESLKISCKGSGYSFTDYYMKWARQMPGKGLEWMGDIIPSNGATFYNQKFKGQVTISADKSISTTYLQWSSLKASDTAMYYCARSHLLRASWFAYWGQGTMVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7073 - protein, 1079 aa, Artificial Sequence
  Synthetic Polypeptide encoding a CAR with optional accessory module(s)
MALPVTALLLPLALLLHAARPDIQMTQSTSSLSASLGDRVTISCSASQGINNYLNWYQQKPDGTVELLIYYTSTLQSGVPSRFSGSGSGTDYSLTISNLEPEDIGTYYCQQYSKLPRTFGGGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLQQSGSELMMPGASVKISCKATGYTFSNYWIEWVKQRPGHGLEWIGEILPGTGRTIYNEKFKGKATFTADISSNTVQMQLSSLTSEDSAVYYCARRDYYGNFYYAMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7074 - protein, 1074 aa, Artificial Sequence
  Synthetic Polypeptide encoding a CAR with optional accessory module(s)
MALPVTALLLPLALLLHAARPDIQMTQSPASLSVSVGETVTITCRASENIYSNLAWYQQKQGKSPQLLVYAATNLADGVPSRFSGSGSGTQYSLKINSLQSEDFGSYYCQHFWGTWTFGGGTTLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLQQSGPELVKPGASVKMSCKASGYTFTDYYMKWMKQSHGKSLEWIGDINPNNGGTTYNQKFKGKATLTVDKSSSTAYMQLNSLTSEDSAVYYCARDYGYGYFDYWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7075 - protein, 1077 aa, Artificial Sequence
  Synthetic Polypeptide encoding a CAR with optional accessory module(s)
MALPVTALLLPLALLLHAARPEIVLTQSPGTLSLSPGERATLSCRASQSVGGYLAWYQQKPGQAPRLLIYDASNRATGIPARFSGSGSGTDFTLTISSLEPEDFAVYYCQQRNNWPPMYTFGQGTKLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKVSCKASGGTFSSYAISWVRQAPGQGLEWMGGIIPILGTANYAQKFQGRVTITADESTSTAYMELSSLRSEDTAVYYCARWGGGAFDIWGQGTMVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7076 - protein, 1072 aa, Artificial Sequence
  Synthetic Polypeptide encoding a CAR with optional accessory module(s)
MALPVTALLLPLALLLHAARPQIVLTQSPALMSASPGEKVTMTCSASSSVRYMYWYQQKPRSSPKPWIHLTSNLASGVPARFSGSGSGTSYSLTISSMEAEDAATYYCQQWSSHPFTFGSGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEDVQLQESGPGLVKPSQSLSLTCTVTGFSITSDYSWNWIRQFPGNKLEWMGYISYSGHTSYNPSLESRISITRDTSKNQFFLQLNSVTTEDTATYYCTRGNWDVVYWGQGTLVTVSATRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7077 - protein, 1082 aa, Artificial Sequence
  Synthetic Polypeptide encoding a CAR with optional accessory module(s)
MALPVTALLLPLALLLHAARPDVVMTQSPLSLPVTLGQPASISCRSSQSIVHSDGNTYLEWYQQRPGQSPRRLIYKVSNRFSGVPDRFSGSGSGTDFTLKISRVEAEDVGVYYCFQGSHAPWTFGGGTKVEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFTFSSYGMHWVRQAPGKGLEWVAYITTRSSTIYYADSVKGRFTISRDNAKNSLYLQMNSLRAEDTAVYYCTREPLTGYYAMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7078 - protein, 1074 aa, Artificial Sequence
  Synthetic Polypeptide encoding a CAR with optional accessory module(s)
MALPVTALLLPLALLLHAARPDIQMTQSPSSLSASVGDRVTITCRASQSISLWLNWYQQKPGKAPKLLIYAASTLQSGVPSRFSGSGSGTDFTLTISSLQPEDFATYYCQQYYTSPYTFGQGTKVEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLLESGGGLVQPGGSLRLSCAASGFTFSSYAMSWVRQAPGKGLEWVSVIRSSGSSTYYADSVKGRFTISRDNSKNTLYLQMNSLRAEDTAVYYCARGGGYFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7079 - protein, 1077 aa, Artificial Sequence
  Synthetic Polypeptide encoding a CAR with optional accessory module(s)
MALPVTALLLPLALLLHAARPDIQMTQSPSSLSASVGDRVTITCRASQSISSYLNWYQQKPGKAPKLLIYAVSTLQSGVPSRFSGSGSGTDFTLTISSLQPEDFATYYCQQSGTFPPTTFGQGTKVEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLLESGGGLVQPGGSLRLSCAASGFTFSSHGMHWVRQAPGKGLEWVSVISGSGSNTGYADSVKGRFTISRDNSKNTLYLQMNSLRAEDTAVYYCARQWGSYAFDSWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7080 - protein, 1087 aa, Artificial Sequence
  Synthetic Polypeptide encoding a CAR with optional accessory module(s)
MALPVTALLLPLALLLHAARPDIVMSQSPSSLAVSVGEKVTMSCKSSQSLLHSSNQKNYLAWYQQKPGQSPKVLIYWASTRESGVPDRFTGSGSGTDFTLTITSVKSEDLAVYYCQQYYSYPWTFGGGTRLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLQQSVAELVKPGASVKMSCKVSGYTLTDHTIHWMKQRPEQGLEWIGYIYPRDGITGYNEKFKGKATLTADTSSSTAYMQLNSLTSEDSAVYFCARWGYSYRNYAYYYDYWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7081 - protein, 1084 aa, Artificial Sequence
  Synthetic Polypeptide encoding a CAR with optional accessory module(s)
MALPVTALLLPLALLLHAARPEIVLTQSPGTLSLSPGERATLSCRASQSVSSSYLAWYQQKPGQAPRLLIYGTSSRATGIPDRFSGSGSGTDFTLTISRLEPEDFAVYYCQQYGSSPFTFGGGTKVEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLAKPSETLSLTCTVSGDSITSYYWSWIRQPPGKGLEWIGYIYYSGSTNYNPSLKSRVTISVDTSKNQFSLKLSSVTAADTAVYYCARDQRRIAAAGTHFYGMDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7082 - protein, 1076 aa, Artificial Sequence
  Synthetic Polypeptide encoding a CAR with optional accessory module(s)
MALPVTALLLPLALLLHAARPDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSATRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7083 - protein, 1069 aa, Artificial Sequence
  Synthetic Polypeptide encoding a CAR with optional accessory module(s)
MALPVTALLLPLALLLHAARPMTQSPKFLLVSAGDRVTLTCKASQSVNNDVYWYQQEPGQSPKLLIYWASTRESGVPDRFTGSGSGTDFTLTISSVQAEDLAVYYCKQSYNLYTFGGGTKLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEESGRGLVQPGGSRKLSCAASGFTFSTSGMHWVRQAPEKGLEWVAYISSGSTTIYHADTVKGRFTISRDNPKNTLFLQMTSLRSEDTAMYYCCARSGQFGNYFDYWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7084 - protein, 1074 aa, Artificial Sequence
  Synthetic Polypeptide encoding a CAR with optional accessory module(s)
MALPVTALLLPLALLLHAARPQSPSSLAVSAGEKVTMSCKSSQSLLNSRTRKNYLAWYQQKPGQSPKLLIYWASTRESGVPDRFTGSGSGTDFTLTISSVQAEDLAVYYCKQSNLYTFGGGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLEESGPELVKPGASVKLSCKASGYTFTEYIIHWVKQRSGQGLEWIGWFYPGSGSIKYNEKFKDKATLTADKSSSTVYMELSGLTSEDSAVYFCARHDGYSYFDYWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7085 - protein, 1086 aa, Artificial Sequence
  Synthetic Polypeptide encoding a CAR with optional accessory module(s)
MEMFQGLLLLLLLSMGGTWASREMLRPRCRPINATLAVEKEGCPVCITVNTTICAGYCPTMTRVLQGVLPALPQVVCNYRDVRFESIRLPGCPRGVNPVVSYAVALSCQCALCRRSTTDCGGPKDHPLTCDDPRFQASSSSKAPPPSLPSPSRLPGPSDTPILPQLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEAPDVQDCPECTLQENPFFSQPGAPILQCMGCCFSRAYPTPLRSKKTMLVQKNVTSESTCCVAKSYNRVTVMGGFKVENHTACHCSTCYYHKSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7086 - protein, 1077 aa, Artificial Sequence
  Synthetic Polypeptide encoding a CAR with optional accessory module(s)
MALPVTALLLPLALLLHAARPDIQMTQSPSSLSASLGERVSLTCRATQELSGYLSWLQQKPDGTIKRLIYAASTLDSGVPKRFSGNRSGSDYSLTISSLESEDFADYYCLQYAIYPYTFGGGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLQQSGPELVKPGASVKMSCKASGYTFTSYFIHWVKQKPGQGLEWIGFINPYNDGSKYNEKFKGKATLTSDKSSSTAYMELSSLTSEDSAVYYCTRDDGYYGYAMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7087 - protein, 1082 aa, Artificial Sequence
  Synthetic Polypeptide encoding a CAR with optional accessory module(s)
MALPVTALLLPLALLLHAARPDTIVLTQSPASLAVSLGQRATISCRASESVDSYGNSFMHWYQQKPGQPPKLLIYLASNLESGVPARFSGSGSRTDFTLTIDPVEADDAATYYCQQNNYDPWTFGGGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLQQSGPELVKPGASVKMSCKASGYTFTSYVMHWVKQKPGQGLEWIGYINPYNDGTKYNEKFKGKATLTSDTSSSTAYMELNSLTSEDSAVYFCARPIYFDNDYFDYWGQGTTLKVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7088 - protein, 1093 aa, Artificial Sequence
  Synthetic Polypeptide encoding a CAR with optional accessory module(s)
MALPVTALLLPLALLLHAARPDLNFMLTQPHSVSGSPGKTVTISCTRSTGSITSNYVHWYQQRPGSSPTTVICEDNERPSGVPDRFSGSIDISSNSASLTISGLKTEDEADYYCQSYDDSNHISVFGTGTKVTVLGQPKANPLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSETLSLTCTVSGGSISSSNYYWGWIRQPPGKGLEWIGAIYYSGSTYYNPSLKSRVAISVDTSKNQFSLKLSSVTAADTAVYYCARRIGVAGQWYFDLWGRGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7089 - protein, 1079 aa, Artificial Sequence
  Synthetic Polypeptide encoding a CAR with optional accessory module(s)
MALPVTALLLPLALLLHAARPDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQIQLVQSGPDLKKPGETVKISCKASGYTFTNTGMNWVKQAPGKGLKWMGWINTYTGEPTYADDFKGRFTFSLETSASTAYLQINNLKNEDTATYFCTRWGYGSSLYYAMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7090 - protein, 1077 aa, Artificial Sequence
  Synthetic Polypeptide encoding a CAR with optional accessory module(s)
MALPVTALLLPLALLLHAARPDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFDFSRYWMSWVRQAPGKGLEWIGEINPDSSTINYAPSLKDKFIISRDNAKNSLYLQMNSLRAEDTAVYYCARPDGNYWYFDVWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7091 - protein, 1077 aa, Artificial Sequence
  Synthetic Polypeptide encoding a CAR with optional accessory module(s)
MALPVTALLLPLALLLHAARPDIVMTQSQKSMSTSVGDRVSITCKASQDVITGVAWYQQKPGQSPKLLIYSASYRYTGVPDRFTGSGSGTDFTFTISNVQAEDLAVYYCQQHYSTPLTFGAGTKLELKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLQQPGAELVRPGASVKLSCKASGYSFTTYWMNWVKQRPGQGLEWIGMIHPSDSETRLNQKFKDKATLTVDKSSSTAYMQLSSPTSEDSAVYYCARSTMIATRAMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7092 - protein, 1083 aa, Artificial Sequence
  Synthetic Polypeptide encoding a CAR with optional accessory module(s)
MALPVTALLLPLALLLHAARPQSVLTQPPSVSGAPGQRVTISCTGSGSNIGAPYDVSWYQQLPGTAPKLLIYHNNKRPSGVPDRFSGSKSGTSASLAITGLQAEDEADYYCATVEAGLSGSVFGGGTKLTVLGALEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSPLTLGLWGQGTMVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7093 - protein, 1083 aa, Artificial Sequence
  Synthetic Polypeptide encoding a CAR with optional accessory module(s)
MALPVTALLLPLALLLHAARPQSVLTQPPSVSGAPGQRVTISCTGSGSNIGAPYDVSWYQQLPGTAPKLLIYHNNKRPSGVPDRFSGSKSGTSASLAITGLQAEDEADYYCQSYDSSSISTIFGGGTKLTVLGALEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSGIAYRPWGQGTMVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7094 - protein, 1090 aa, Artificial Sequence
  Synthetic Polypeptide encoding a CAR with optional accessory module(s)
MDWIWRILFLVGAATGAHSFEVQLVESGGGSVQAGGSLRLSCTTSGRALNMYVMGWFRQAPGNEREFVAATSSSGGSTSYPDSVKGRFTISRDNAKNTVYLQMNSLKPEDTAAYRCAASPYVSTPTMNILEEYRYWGLGTQVTVSSLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEVQLVESGGGLVQAGGSLRLSCAASGSIFSGNVMGWYRRQAPGKEREWVAAIASGGSIYYRDSVKGRFTISRDNAKNTVYLQMNSLKPEDTAVYYCNSHPPTLPYWGLGTQVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7095 - protein, 1167 aa, Artificial Sequence
  Synthetic Polypeptide encoding a CAR with optional accessory module(s)
MDWIWRILFLVGAATGAHSFEVQLVESGGGSVQAGGSLRLSCTTSGRALNMYVMGWFRQAPGNEREFVAATSSSGGSTSYPDSVKGRFTISRDNAKNTVYLQMNSLKPEDTAAYRCAASPYVSTPTMNILEEYRYWGLGTQVTVSSLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMALPVTALLLPLALLLHAARPGMRTEDLPKAVVFLEPQWYRVLEKDSVTLKCQGAYSPEDNSTQWFHNESLISSQASSYFIDAATVDDSGEYRCQTNLSTLSDPVQLEVHIGWLLLQAPRWVFKEEDPIHLRCHSWKNTALHKVTYLQNGKGRKYFHHNSDFYIPKATLKDSGSYFCRGLVGSKNVSSETVNITITQGLAVSTISSFFPPGYQTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7096 - protein, 1167 aa, Artificial Sequence; identical to SEQ ID NO: 7095
  Synthetic Polypeptide encoding a CAR with optional accessory module(s)

SEQ ID NO: 7097 - protein, 1217 aa, Artificial Sequence
  Synthetic Polypeptide encoding a CAR with optional accessory module(s)
MDWIWRILFLVGAATGAHSFEVQLVESGGGSVQAGGSLRLSCTTSGRALNMYVMGWFRQAPGNEREFVAATSSSGGSTSYPDSVKGRFTISRDNAKNTVYLQMNSLKPEDTAAYRCAASPYVSTPTMNILEEYRYWGLGTQVTVSSLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSATMALPVTALLLPLALLLHAARPDVQLQESGPGLVKPSQSLSLTCTVTGYSITSDYTWNWIRQFPGNKLEWMGYITYSGSTSYNPSLKSRNSITRDTSKNQFFLQLNSVTTEDTATYYCARLGRRYTMDYWGQGTSVTVSSGGGGSGGGGSGGGGSDIQMTQSSSSFSVSLGDRVTITCMASEDIYIRLAWYQQKPGNAPRLLISAATSLETGVPSRFSGSGSGKDYTLSITSLQTEDVGTYYCQQYWSSPWTFGGGTKLEINTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7098 - protein, 1090 aa, Artificial Sequence
  Synthetic Polypeptide encoding a CAR with optional accessory module(s)
MALPVTALLLPLALLLHAARPDEFEVQLVESGGGLVQAGGSLRLSCVASGISSSKRNMGWYRQAPGKQRESVATISSGGNKDYTDAVKDRFTISRDTTKNTVYLQMNSLKPEDTAVYYCKIEAGTGWATRRGYTYWGQGTLVTVSSLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEVQLVESGGGLVQAGGSLRLSCAASGSIFSGNVMGWYRRQAPGKEREWVAAIASGGSIYYRDSVKGRFTISRDNAKNTVYLQMNSLKPEDTAVYYCNSHPPTLPYWGLGTQVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7099 - protein, 1104 aa, Artificial Sequence
  Synthetic Polypeptide encoding a CAR with optional accessory module(s)
MALPVTALLLPLALLLHAARPDEFEVQLVESGGGLVQAGDSLRLSCAASGRAFSRYAMGWFRQAPGKEREFVAAIGWGPSKTNYADSVKGRFTISRDNAKNTVYLQMNTLKPEDTAVYSCAAKFVNTDSTWSRSEMYTYWGQGTLVTVSSLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEVQLVESGGGSVQAGGSLRLSCTTSGRALNMYVMGWFRQAPGNEREFVAATSSSGGSTSYPDSVKGRFTISRDNAKNTVYLQMNSLKPEDTAAYRCAASPYVSTPTMNILEEYRYWGLGTQVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7100 - protein, 1081 aa, Artificial Sequence
  Synthetic Polypeptide encoding a CAR with optional accessory module(s)
MALPVTALLLPLALLLHAARPDIQMTQSPSSLSASVGDRVTITCSASSSVSYMYWYQQKPGKAPKLLIYLTSNLASGVPSRFSGSGSGTDFTLTISSLQPEDFATYYCQQWRSNPFTFGQGTKLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQITLKESGPTLVKPTQTLTLTCTFSGFSLSTSGMGVGWIRQPPGKALEWLAHIWWDDVKRYSPSLKSRLTITKDTSKNQVVLTMTNMDPVDTATYYCARIVSFDNDVVSAMDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7101 - protein, 1076 aa, Artificial Sequence
  Synthetic Polypeptide encoding a CAR with optional accessory module(s)
MALPVTALLLPLALLLHAARPEIVMTQSPATLSVSPGERATLSCKASQSVSNDVVWYQQKPGQAPRLLIYYASNRYTGIPARFSGSGSGTEFTLTISSLQSEDFAVYYCQQDYTSPWTFGQGTKLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFTNYGMNWVRQAPGQGLEWMGWINTYTGEPTYADDFKGRVTMTTDTSTSTAYMELRSLRSDDTAVYYCARIGDSSPSDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7102 - protein, 1077 aa, Artificial Sequence
  Synthetic Polypeptide encoding a CAR with optional accessory module(s)
MALPVTALLLPLALLLHAARPDSTDIQMTQSPSSLSASVGDRVTITCRASQSISSYLNWYQQKPGKAPKLLIYLASNLQSGVPSRFSGSGSGTDFTLTISSLQPEDFATYYCQQAEYMPLTFGQGTKVEIKRALEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGLVQPGGSLRLSCAASGFTFSGYAMSWVRQAPGKGLEWVSEIAPPGLNTRYADSVKGRFTISRDNSKNTLYLQMNSLRAEDTAVYYCAKSDTAFDYWGQGTLVTVSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7103 - protein, 1080 aa, Artificial Sequence
  Synthetic Polypeptide encoding a CAR with optional accessory module(s)
MALPVTALLLPLALLLHAARPDQAVLTQESALTTSPGETVTLTCRSSTGAVTTSNYANWVQEKPDHLFTGLIGGTNNRVPGVPARFSGSLIGDKAALTITGAQTEDEAIYFCVLWHSNHWVFGGGTKLTVLLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEDVQLVESGGGLVQPGGSRKLSCAASGFTFSSFGMHWVRQAPEKGLEWVAYISSGSSTLHYADTVKGRFTISRDNPKNTLFLQMTSLRSEDTAMYYCARWGNYPHYAMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7104 - protein, 1102 aa, Artificial Sequence
  Synthetic Polypeptide encoding a CAR with optional accessory module(s)
MALPVTALLLPLALLLHAARPDEFEVQLVESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTLVTVSSLELEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGSVQAGGSLRLSCAASGDTYGSYWMGWFRQAPGKEREGVAAINRGGGYTVYADSVKGRFTISRDTAKNTVYLQMNSLRPDDTADYYCAASGVLGGLHEDWFNYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7105 - protein, 1099 aa, Artificial Sequence
  Synthetic Polypeptide encoding a CAR with optional accessory module(s)
MALPVTALLLPLALLLHAARPDEFEVQLVESGGGSVQAGGSLRLTCAASGSTSRSYGMGWFRQAPGKEREFVSGISWRGDSTGYADSVKGRFTISRDNAKNTVDLQMNSLKPEDTAIYYCAAAAGSTWYGTLYEYDYWGQGTLVTVSSLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEVQLVESGGGSVQAGGSLRLSCAASGDTYGSYWMGWFRQAPGQEREAVAAINRGGGYTVYADSVKGRFTISRDNAKNTLYLQMNSLRPDDTADYYCAASGVLGGLHEDWFNYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7106 - protein, 1071 aa, Artificial Sequence
  Synthetic Polypeptide encoding a CAR with optional accessory module(s)
MALPVTALLLPLALLLHAARPDIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVELEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7107 - protein, 1077 aa, Artificial Sequence
  Synthetic Polypeptide encoding a CAR with optional accessory module(s)
MALPVTALLLPLALLLHAARPDEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7108 - protein, 1084 aa, Artificial Sequence
  Synthetic Polypeptide encoding a CAR with optional accessory module(s)
MALPVTALLLPLALLLHAARPDELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7109 - protein, 1085 aa, Artificial Sequence
  Synthetic Polypeptide encoding a CAR with optional accessory module(s)
MALPVTALLLPLALLLHAARPDELQMTQSPSSLSASVGDRVTITCRASQSISSYLNWYQQKPGQPPKLLIYWASTRESGVPDRFSGSESGTNYTLTISSLQPEDFATYFCQQSDSLPITFGQGTRLDIQLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGVVQPGRSLRLSCAASGFTFSSYGMHWVRQAPGKGLEWVAVISYDGSNKYYADSVKGRFTISRDNSKNTLYLQMNSLRAEDTAVYYCAKDMGWGSGWRPYYYYGMDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7110 - protein, 1082 aa, Artificial Sequence
  Synthetic Polypeptide encoding a CAR with optional accessory module(s)
MALPVTALLLPLALLLHAARPDDIQMTQSPSSLSASVGDRVTITCRASQSISSYLNWYQQKPGKAPKLLIYAASSLQSGVPSRFSGSGSGTDFTLTISSLQPEDLATYYCQQSYSTPFTFGPGTKVDIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEVHEVQLVQSGAEVKKPGSSVKVSCKASGGTFSSYAISWVRQAPGQGLEWMGGIIPIFGTANYAQKFQGRVTITADKSTSTAYMELSSLRSEDTAVYYCATFALFGFREQAFDIWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7111 - protein, 1079 aa, Artificial Sequence
  Synthetic Polypeptide encoding a CAR with optional accessory module(s)
MALPVTALLLPLALLLHAARPDVVMTQTPLSLPVSLGDQASISCRSSQSLVHSNGNTYLRWYLQKPGQSPKVLIYKVSNRFSGVPDRFSGSGSGTDFTLKISRVEAEDLGVYFCSQSTHVPWTFGGGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVKLDETGGGLVQPGRPMKLSCVASGFTFSDYWMNWVRQSPEKGLEWVAQIRNKPYNYETYYSDSVKGRFTISRDDSKSSVYLQMNNLRVEDMGIYYCTGSYYGMDYWGQGTSVTVSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7112 - protein, 1081 aa, Artificial Sequence
  Synthetic Polypeptide encoding a CAR with optional accessory module(s)
MALPVTALLLPLALLLHAARPDIQMTQSPSSLSASVGDRVTITCRTSQSLSSYTHWYQQKPGKAPKLLIYAASSRGSGVPSRFSGSGSGTDFTLTISSLQPEDFATYYCQQSRTFGQGTKVEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLQQSGPGLVKPSQTLSLTCAISGDSVSSYNAVWNWIRQSPSRGLEWLGRTYYRSGWYNDYAESVKSRITINPDTSKNQFSLQLNSVTPEDTAVYYCARSGHITVFGVNVDAFDMWGQGTMVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7113 - protein, 1080 aa, Artificial Sequence
  Synthetic Polypeptide encoding a CAR with optional accessory module(s)
MALPVTALLLPLALLLHAARPDIVLTQSPLSLAVSLGQPAIISCKASQSVSFAGTSLMHWYHQKPGQQPRLLIYRASNLEAGVPDRFSGSGSKTDFTLTISPVEAEDAATYYCQQSREYPYTFGGGTKLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVVKPGASVKISCKASGYTFTGYFMNWVKQSPGQSLEWIGRIHPYDGDTFYNQKFQGKATLTVDKSSNTAHMELLSLTSEDFAVYYCTRYDGSRAMDYWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7114 - protein, 1053 aa, Artificial Sequence
  Synthetic Polypeptide encoding a CAR with optional accessory module(s)
MALPVTALLLPLALLLHAARPNSCELTNITIAIEKEECRFCISINTTWCAGYCYTRDLVYKDPARPKIQKTCTFKELVYETVRVPGCAHHADSLYTYPVATQCHCGKCDSDSTDCTVRGLGPSYCSFGEMKELEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEAPDVQDCPECTLQENPFFSQPGAPILQCMGCCFSRAYPTPLRSKKTMLVQKNVTSESTCCVAKSYNRVTVMGGFKVENHTACHCSTCYYHKSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7115 - protein, 1077 aa, Artificial Sequence
  Synthetic Polypeptide encoding a CAR with optional accessory module(s)
MALPVTALLLPLALLLHAARPDDVVMTQTPLSLPVTPGEPASISCRSSQSLVHRNGNTYLHWYLQKPGQSPKLLIHKVSNRFSGVPDRFSGSGSGTDFTLKISRVEAEDLGVYFCSQSTHVPPLTFGAGTKLELKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVEKPGASVKISCKASGSSFTGYNMNWVRQNIGKSLEWIGAIDPYYGGTSYNQKFKGRATLTVDKSTSTAYMHLKSLRSEDTAVYYCVSGMEYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7116 - protein, 1075 aa, Artificial Sequence
  Synthetic Polypeptide encoding a CAR with optional accessory module(s)
MALPVTALLLPLALLLHAARPDEIVMTQTPATLSVSAGERVTITCKASQSVSNDVTWYQQKPGQAPRLLIYSASNRYSGVPARFSGSGYGTEFTFTISSVQSEDFAVYFCQQDYSSFGQGTKLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVESGPGVVQPGRSLRISCAVSGFSVTNYGVHWVRQPPGKGLEWLGVIWAGGITNYNSAFMSRLTISKDNSKNTVYLQMNSLRAEDTAMYYCASRGGHYGYALDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7117 - protein, 1077 aa, Artificial Sequence
  Synthetic Polypeptide encoding a CAR with optional accessory module(s)
MALPVTALLLPLALLLHAARPDIQMTQTASSLPASLGDRVTISCSASQDISNYLNWYQQKPDGTVKLLIFYSSNLHSGVPSRFSGGGSGTDYSLTISNLEPEDIATYFCHQYSKLPWTFGGGTKLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVTLVESGGDFVKPGGSLKVSCAASGFAFSHYAMSWVRQTPAKRLEWVAYISSGGSGTYYSDSVKGRFTISRDNAKNTLYLQMRSLRSEDSAMYFCTRVKLGTYYFDSWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7118 - protein, 1079 aa, Artificial Sequence
  Synthetic Polypeptide encoding a CAR with optional accessory module(s)
MALPVTALLLPLALLLHAARPQFVLTQSPSASAALGASAKLTCTLSSAHKTYTIDWYQQQKGKAPRYLIQVKSDGTYTKATGVPDRFSGSSSGADRYLIIPSVQADDEADYYCGTDYTGGYVFGGGTQLTVTLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEQLKESGGGLFKPTDTLTLTCTVSGFSLSYYGVNWVRQAPGNGLEWIGTIGGSGDTYYASWAKSRSTIIRNTNENTVTLKMTSLTAADTATYFCVRYANIGYEYFNVWGPGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7119 - protein, 1084 aa, Artificial Sequence
  Synthetic Polypeptide encoding a CAR with optional accessory module(s)
MALPVTALLLPLALLLHAARPQFVLTQSPSVSAALGASAKLTCTLSSAHKTYTIDWYQQQQGEAPRYLMQVKSDGSYTKGTGVPDRFSGSSSGADRYLIIPSVQADDEAGYVCGADDNGGYVFGGGTQLTVTLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQSVKESEGGLFKPTDTLTLTCTVSGFSLSRHALTWVRQAPGNGLEWIGAIDNAGTTYYASWAKSRSTITRNTDLHTVTLKMTSLTASDTATYFCARVFYDINSGYYLDGMDLWGPGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7120 - protein, 1078 aa, Artificial Sequence
  Synthetic Polypeptide encoding a CAR with optional accessory module(s)
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGESLRLSCVASGFTFSRYKMNWVRQAPGKGLEWVSYISRSGRDIYYADSVKGRFTISRDNAKNSLYLQMNSLRDEDTAVYYCAGTVTTYYYFGMDVWGHGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7121 - protein, 1079 aa, Artificial Sequence
  Synthetic Polypeptide encoding a CAR with optional accessory module(s)
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGSVQPGESLRLSCVASGFTFSRYKMNWVRQAPGKGLEWVSYISRSGRDIYYADSVKGRFTISRDNAKNSLYLQMNSLRDEDTAVYYCAGTVTTYYYDFGMDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7122 - protein, 1077 aa, Artificial Sequence
  Synthetic Polypeptide encoding a CAR with optional accessory module(s)
MALPVTALLLPLALLLHAARPQSVLTQPPSASGTPGQRVTISCSGSRSNVGGNYVFWYQQVPGATPKLLIYRSNQRPSGVPDRFAGSKSGSSASLAISGLRSEDEADYYCATWDDSLSGFVFGTGTKVTVLGLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARGYGKAYDQWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7123 - protein, 1076 aa, Artificial Sequence
  Synthetic Polypeptide encoding a CAR with optional accessory module(s)
MALPVTALLLPLALLLHAARPQSVVTQPPSMSAAPGQQVTISCSGGNSNIERNYVSWYLQLPGTAPKLVIFDNDRRPSGIPDRFSGSKSGTSATLGITGLQTGDEADYYCGTWDSSLRGWVFGGGTKLTVLGLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEVQLVESGGGLIQPGGSLRLSCAASGFTFSNYAMNWVRQAPGKGLEWVSTINGRGSSTIYADSVKGRFTISRDNSKNTLYLQMNSLRAEDTATYYCARYISRGLGDSWGQGTLVTVTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7124 - protein, 1077 aa, Artificial Sequence
  Synthetic Polypeptide encoding a CAR with optional accessory module(s)
MALPVTALLLPLALLLHAARPDNIELTQSPAIMSASPGERVTMTCSASSSIRYIYWYQQKPGSSPRLLIYDTSNVAPGVPFRFSGSGSGTSYSLTINRMEAEDAATYYCQEWSGYPYTFGGGTKLDIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVKLQESGGGLVKPGGSLKLSCAASGFTFSSYGMSWVRQTPDKRLEWVATISSGGSYTYYPDSVKGRFTISRDNAKNTLYLQMSSLKSEDTAMYYCARGNWEGWYFDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7125 - protein, 1087 aa, Artificial Sequence
  Synthetic Polypeptide encoding a CAR with optional accessory module(s)
MALPVTALLLPLALLLHAARPDNFMLTQPHSVSESPGKTVTISCTGSGGSIDNNYVHWYQQRPGSAPTTVMFEDNQRPSGVPDRFSGSIDSSSNSASLVISGLKTEDEGDYYCQSSDGSKVVFGGGTKLTVLGQLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLVQSGGGSLTLSCAASGVVQPGRFTFSSYGMHWVRQAPGKGLEWVSVISYDGSNKYYADSVKGRFTISRDNSKNTLYLQMNSLRTEDTAVYYCAKTLSAGEWIGGGAFDIWGHGTMVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7126 - protein, 1077 aa, Artificial Sequence
  Synthetic Polypeptide encoding a CAR with optional accessory module(s)
MALPVTALLLPLALLLHAARPDVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQNTPVPPKFGSGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLQQSGAELVRPGASVKLSCKASGYTFNDYEMHWVKQTPVHGLKWIGALEPKTGDTAYSQKFKGKATLTADKSSSTAYMELRSLTSEDSAVYYCTSCYYYTYSGQGTLVTVSATRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7127 - protein, 1076 aa, Artificial Sequence
  Synthetic Polypeptide encoding a CAR with optional accessory module(s)
MALPVTALLLPLALLLHAARPDIQLTQSPSSLSASVGDRVTITCRASQGIRNDLGWYQQKPGKAPKRLIYAASSLQNGVPSRFSGSGSGTEFTLTISSLQPEDFATYYCLQHNTYPAFGQGTKVEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTLSLTCTVSGGSISSFNYYWSWIRHHPGKGLEWIGYIYYSGSTYSNPSLKSRVTISVDTSKNQFSLTLSSVTAADTAVYYCARGYNWNYFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7128 - protein, 1078 aa, Artificial Sequence
  Synthetic Polypeptide encoding a CAR with optional accessory module(s)
MALPVTALLLPLALLLHAARPDDIVLTQSPASLAVSLGQSVTISCRASESVEYYGTSLMQWYQQKPGQPPKLLIYATSNVESGVPARFSGSGSGTDFSLNIHPVEEDDIAMYFCQQSRKLPSTFGGGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEDVRLQESGPGQVKPSQTVSLTCSVTGYSITNGNHWWNWIRQVSGSKLEWIGYISSSGSTDSNPSLKSRISITRDTSKNQLFLQLNSVTTEDIATYYCARGYYFDYWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7129 - protein, 1103 aa, Artificial Sequence
  Synthetic Polypeptide encoding a CAR with optional accessory module(s)
MALPVTALLLPLALLLHAARPDEFGSDLGIKLLFAAAKGQDDEVRILLAAGADVNAKDFEGYTPLHVAAYDGHLEIVEVLLKAGADVNAKDSQGRTPLHEAAYSGHLEIVEVLLKAGADVNAQDDAGETPADLAAAWGHEDIAEVLQKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFERSDLGKKLLEAARAGQDDEVRILMANGADVNAKDEYGLTPLYLATAHGHLEIVEVLLKNGADVNAVDAIGFTPLHLAAFIGHLEIAEVLLKHGADVNAQDKFGKTAFDISIGNGNEDLAEILQKLNTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7130 - protein, 1089 aa, Artificial Sequence
  Synthetic Polypeptide encoding a CAR with optional accessory module(s)
MALPVTALLLPLALLLHAARPDEFEVQLVESGGGLVQAGGSLRLSCAASGITFSINTMGWYRQAPGKQRELVALISSIGDTYYADSVKGRFTISRDNAKNTVYLQMNSLKPEDTAVYYCKRFRTAAQGTDYWGQGTQVTVSSLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEVQLVESGGGLVQPGGSLRLSCAASGSIFGFNDMAWYRQAPGKQRELVALISRVGVTSSADSVKGRFTISRVNAKDTVYLQMNSLKPEDTAVYYCYMDQRLDGSTLAYWGQGTQVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7131 - protein, 1077 aa, Artificial Sequence
  Synthetic Polypeptide encoding a CAR with optional accessory module(s)
MALPVTALLLPLALLLHAARPDIQMTQSPSSLSASVGDRVTITCRASQDVNTAVAWYQQKPGKAPKLLIYSASFLESGVPSRFSGSRSGTDFTLTISSLQPEDFATYYCQQHYTTPPTFGQTKVEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDVWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7132 - protein, 1094 aa, Artificial Sequence
  Synthetic Polypeptide encoding a CAR with optional accessory module(s)
MALPVTALLLPLALLLHAARPDEFDVQLVESGGGLVQPGGSLRLSCAASGSIGGLNAMAWYRQAPGKERELVAGIFGVGSTRYADSVKGRFTISRDNSKNTVYLQMNSLRPEDTAVYYCRMSSVTRGSSDYWGQGTLVTVSSLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEVQLVESGGSLVQPGGSLRLSCAASGFTFDDYAMSWVRQVPGKGLEWVSSINWSGTHTDYADSVKGRFTISRNNANNTLYLQMNSLKSEDTAVYYCAKNWRDAGTTWFEKSGSAGQGTQVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7133 - protein, 1076 aa, Artificial Sequence
  Synthetic Polypeptide encoding a CAR with optional accessory module(s)
MALPVTALLLPLALLLHAARPDQSVLTQPPSVSVAPGKTARIPCEGNYIGSSNVHWYQQKPGQAPVLVIHFDSDRPSGIPDRFSGSNSGNMATLTISRVEAGDEADYYCQVWENHGWVFGGGTKLTVLSLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLVETGGGLVQPGESLRLSCAASGFTFSDYEMNWVRQAPGKGLEWVSYISSSGSTIYYADSVKGRFTIYRDNAKNSLYLQMNSLRAEDTALYYCARAWGVGPPDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7134 - protein, 1084 aa, Artificial Sequence
  Synthetic Polypeptide encoding a CAR with optional accessory module(s)
MALPVTALLLPLALLLHAARPDIQMTQSPSSLSASVGDTVTITCQANGYLNWYQQRRGKAPKLLIYDGSKLERGVPSRFSGRRWGQEYNLTINNLQPEDIATYFCQVYEFVVPGTRLDLKRTVAAPLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVSSASTKGPTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7135 - protein, 1090 aa, Artificial Sequence
  Synthetic Polypeptide encoding a CAR with optional accessory module(s)
MALPVTALLLPLALLLHAARPQSALTQPPSASGSPGQSITISCTGTSNNFVSWYQQHAGKAPKLVIYDVNKRPSGVPDRFSGSKSGNTASLTVSGLQTDDEAVYYCGSLVGNWDVIFGGGTKLTVLLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQPQLQESGPTLVEASETLSLTCAVSGDSTAACNSFWGWVRQPPGKGLEWVGSLSHCASYWNRGWTYHNPSLKSRLTLALDTPKNLVFLKLNSVTAADTATYYCARFGGEVLRYTDWPKPAWVDLWGRGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7136 - protein, 1075 aa, Artificial Sequence
  Synthetic Polypeptide encoding a CAR with optional accessory module(s)
MALPVTALLLPLALLLHAARPEIVLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGGQMKKPGESMRISCRASGYEFIDCTLNWIRLAPGKRPEWMGWLKPRGGAVNYARPLQGRVTMTRDVYSDTAFLELRSLTVDDTAVYFCTRGKNCDYNWDFEHWGRGTPVIVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7137 - protein, 1085 aa, Artificial Sequence
  Synthetic Polypeptide encoding a CAR with optional accessory module(s)
MALPVTALLLPLALLLHAARPELVLTQSPGTLSLSAGERATLSCRASQSVSSGSLAWYQQKPGQAPRLLIYGASTRATGIPDRFSGSGSGTDFTLTIGRLEPEDLAVYYCQQYGTSPYTFGQGTKLEILEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFELEQSGAEVKKPGSSVQVSCKASGGTFSMYGFNWVRQAPGHGLEWMGGIIPIFGTSNYAQKFRGRVTFTADQATSTAYMELTNLRSDDTAVYYCARDFGPDWEDGDSYDGSGRGFFDFWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7138 - protein, 1081 aa, Artificial Sequence
  Synthetic Polypeptide encoding a CAR with optional accessory module(s)
MALPVTALLLPLALLLHAARPDDIVMTQSQDSMATSVGERVTVNCKASQNVDTNVAWYQQKPGQSPEPLLFSASYRYTGVPDRFSGSGSGTDFTLTISSVQAEDVAEYFCQQYNSYPLTFGQGTKLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQVEVSGGGLVQPGGSMRLSCAVSGFTFSNYWMNWVRQSPEKGLEWIAEIRLKSNNFARYYAESVKGRFTISRDNSKNSLYLQMISLRAEDTAIYYCTSYGNYVGHYFDHWGQGTLLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7139 - protein, 1088 aa, Artificial Sequence
  Synthetic Polypeptide encoding a CAR with optional accessory module(s)
MALPVTALLLPLALLLHAARPDEIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPRTFGQGTKVEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGGGVVQPGRSLRLSCAASGFTFSSYGMHWVRQAPGKGLEWVAVISYDGSNKYYADSVKGRFTISRDNSKNTLYLQMNSLRAEDTAVYYCARDFDYGDSYYYYGMDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7140 - protein, 1082 aa, Artificial Sequence
  Synthetic Polypeptide encoding a CAR with optional accessory module(s)
MALPVTALLLPLALLLHAARPDEIVLTQSPATLSLSPGERATLSCRASQSVGSYLAWYQQKPGAPRLLIYDASHRATGIPARFSGSGSGTDFTLTISSLEPEDFAVYYCQQRSNWPPMYTFGQGTKLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVSVKVSCKASGGKKPGSTFSSYTISWVRQAPGQGLEWMGGIIPIFGTANYAQKFQGRVTITADKSTSTAYMELSSLRSEDTAVYYCAGDTDSSGYYGAVDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7141 - protein, 1065 aa, Artificial Sequence
  Synthetic Polypeptide encoding a CAR with optional accessory module(s)
MALPVTALLLPLALLLHAARPDIQMTQSPSSLSASVGDRVTITCQASQDINNYLNWYQQKPGKAPKLLIYDASNLQTGVPSRFSGSGSGTDFTFTIEDIATYYCQQYTFGPGTKVDIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGLVQPGGSLRLSCAASGFTFSWYSMTWVRQAPGKGLEWVSSIVPWGDFTQYADSVKGRFTISRDNSKNTLYLQMNSLRAEDTAVYYCAKGPGWGSFDLWGRGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7142 - protein, 1211 aa, Artificial Sequence
  Synthetic Polypeptide encoding a CAR with optional accessory module(s)
MDWIWRILFLVGAATGAHSEVQLVESGGGLVQPGGSLRLSCAASGSVFKINVMAWYRQAPGKGRELVAGIISGGSTSYADSVKGRFTISRDNAKNTLYLQMNSLRPEDTAVYYCAFITTESDYDLGRRYWGQGTLVTVSSLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7143 - protein, 1075 aa, Artificial Sequence
  Synthetic Polypeptide encoding a CAR with optional accessory module(s)
MALPVTALLLPLALLLHAARPDIQMTQSPSSLSASVGDRVTITCTASLSVSSTYLHWYQQKPGSSPKLWIYSTSNLASGVPSRFSGSGSGTSYTLTISSLQPEDFATYYCHQYHRSPLTFGGGTKVEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFSLTKYGVHWVRQAPGKGLEWVGVKWAGGSTDYNSALMSRFTISKDNAKNSLYLQMNSLRAEDTAVYYCARDHRDAMDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7144 - protein, 1079 aa, Artificial Sequence
  Synthetic Polypeptide encoding a CAR with optional accessory module(s)
MALPVTALLLPLALLLHAARPDIQMTQSPSSLSASVGDRVTITCKASQDVGTAVAWYQQKPGKAPKLLIYSASYRSTGVPSRFSGSGSGTDFTLTISSLQPEDFATYYCQHHYSAPWTFGGGTKVEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFTFSRNGMSWVRQAPGKGLEWVATVSSGGSYIYYADSVKGRFTISRDNAKNSLYLQMNSLRAEDTAVYYCARQGTTALATRFFDVWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7145 - protein, 1085 aa, Artificial Sequence
  Synthetic Polypeptide encoding a CAR with optional accessory module(s)
MALPVTALLLPLALLLHAARPDIVMTQSPSSLTMSVGQKVTMSCKSSHSLLNSRNQKNYLAWFQQKPGQSPKLLVYFASTRESGVPDRFIGSGSGTDFTLTISNVQAEDLADYFCQQHYTTLPTFGGGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQIQLVQSGPDLKKPGETVKISCKASGYTFTNTGMNWVKQAPGKGLKWMGWINTYTGEPTYADDFKGRFTFSLETSASTAYLQINNLKNEDTATYFCTRWGYGSSLYYAMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7146 - protein, 1075 aa, Artificial Sequence
  Synthetic Polypeptide encoding a CAR with optional accessory module(s)
MALPVTALLLPLALLLHAARPDIQMTQSPPSLSASVGGKVTITCKASQDIDRYMAWYQDKPGKGPKLLIHDTSTLQPGIPSRFSGSGSGRDYSFSISNLEPEDIATYYCLQYDNLWTFGGGTKLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAELVKPGASVKMSCKASGYIFTNYNIHWVKKSPGQGLEWIGAIYPGNGDAPYSQKFQDRATLTADTSSSTTYMELSSLTSEDSAVYYCVRANWDVAFAYWGQGTLVSVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7147 - protein, 1076 aa, Artificial Sequence
  Synthetic Polypeptide encoding a CAR with optional accessory module(s)
MALPVTALLLPLALLLHAARPDIQMTQSPASLSASVGETVTITCRVSGNIHNYLAWYQQKQGKSPQLLVYNAKTLADGVPSRFSGSGSGTQYSLKINSLQPEDFGSYYCQHFWSNPYTFGGGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLQQSGASVKVSCKASELVRPGTGYAFTNYLIEWVKQRPGQGLEWIGVINPGSGGTNYNEKFKGKATLTADKSSSTAYMQLSSLTSDDSAVYFCARYRSYDWYFDVWGAGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7148 - protein, 1081 aa, Artificial Sequence
  Synthetic Polypeptide encoding a CAR with optional accessory module(s)
MALPVTALLLPLALLLHAARPDDIQMTQSPSSLSASVGDRVTITCRSSQRIVHSNGNTYLEWYQQTPGKAPKLLIYKVSNRFSGVPSRFSGSGSGTDYTPTISSLQPEDIATYYCFQGSHVPPTFGQGTKLQITLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGVVQPGRSLRLSCSSSGPTFSDYYMYWVRQAPGKGLEWVAYMSNVGAITDYPDTVKGRPTISRDNSKNTLFLMDSLRPEDTGVYFCARGTRDGSWFAYWGQGTPVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7149 - protein, 1075 aa, Artificial Sequence
  Synthetic Polypeptide encoding a CAR with optional accessory module(s)
MALPVTALLLPLALLLHAARPDIQMTQSFSSLSASVGDRVTITCRASQDISNYLNWYQQKPGKAPKLLIYYTSRLHSGVPSRFSGSGSGTDYTLTISSLQPEDFATYFCQQGNTLPWTFGGGTKLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLVQSGGGLVQSGGSLRLSCRASGYTFTRYWMLWVRQRPGKGLEWVAEINPRNDRTNYNEKFKTRFTISVDRSKNTLYLQMDSLRAEDTAVYFCALGGGYAMDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7150 - protein, 1062 aa, Artificial Sequence
  Synthetic Polypeptide encoding a CAR with optional accessory module(s)
MEMLQGLLLLLLLSMGGAWASREPLRPWCHPINAILAVEKEGCPVCITVNTTICAGYCPTMMRVLQAVLPPLPQVVCTYRDVRFESIRLPGCPRGVDPVVSFPVALSCRCGPCRRSTSDCGGPKDHPLTCDHPQLSGLLFLLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEAPDVQDCPECTLQENPFFSQPGAPILQCMGCCFSRAYPTPLRSKKTMLVQKNVTSESTCCVAKSYNRVTVMGGFKVENHTACHCSTCYYHKSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7151 - protein, 1076 aa, Artificial Sequence
  Synthetic Polypeptide encoding a CAR with optional accessory module(s)
MALPVTALLLPLALLLHAARPDIQMTQSPASLSASVGETVTIICRASVNIYSYLAWYQQKQGKSPQLLVYNAKILAEGVPSRFSGSGSGTQFSLKINSLQPEDFGSYYCQHHYGTFTFGSGTKLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLKESGPGLVAPSQSLSITCTISGFSLTSYGVHWVRQPPGKGLEWLVVIWSDGSTTYNSALKSRLSISKDNSKSQVFLKMNSLQTDDTAIYYCASHYGSTLAFASWGHGTLVTVSAATRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7152 - protein, 1084 aa, Artificial Sequence
  Synthetic Polypeptide encoding a CAR with optional accessory module(s)
MALPVTALLLPLALLLHAARPDIVMTQSHKFMSTSVGDRVSVTCKASQNVGNNVAWYQQKPGQSPKVLIYSASYRYSGVPDRFTGSGSGTDFTLTISNVQSEDLAEYFCQQYNTYPFTFGSGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLEESGGGLVQPGGSMKLSCVASGFTFSNYWMNWVRQSPEKGLEWVAEIRFKSHNYATHFAESVKGRFTISRDDSKSSVYLQMNNLRAEDTGIYYCTRRIGNSDYDWWYFDVWGAGTSVTVSSASTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7153 - protein, 1080 aa, Artificial Sequence
  Synthetic Polypeptide encoding a CAR with optional accessory module(s)
MALPVTALLLPLALLLHAARPDDIQLTQSPSSLSASVGDRVTITCKASQSVDYEGDSFLNWYQQKPGKAPKLLIYAASNLESGVPSRFSGSGSGTDFTLTISSLQPEDFATYYCQQSNEDPLTFGQGTKVEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGYTFSSYWIEWVRQAPGKGLEWIGEILPGGGDTNYNEIFKGRATFSADTSKNTAYLQMNSLRAEDTAVYYCTRRVPIRLDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7154 - protein, 1086 aa, Artificial Sequence
  Synthetic Polypeptide encoding a CAR with optional accessory module(s)
MALPVTALLLPLALLLHAARPDQSVLTQPPSVSGAPGQRVTISCTGSSSNIGAGYDVHWYQQLPGTAPKLLIYGNSNRPSGVPDRFSGSKSGTSASLAITGLQAEDEADYYCQSYDNSLSSWVFGGGTKLTVLGQPKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLQQSGAEVKKPGSSVKVSCKASGGTFSSYAISWVRQAPGQGLEWMGRIIPILGIANYAQKFQGRVTITADKSTSTAYMELSSLRSEDTAVYYCARDVGSGSYSLDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7155 - protein, 1083 aa, Artificial Sequence
  Synthetic Polypeptide encoding a CAR with optional accessory module(s)
MALPVTALLLPLALLLHAARPDQSVVTQPPSVSAAPGRKVTISCSGSSSNIGSNYVSWYQQVPGTAPKLLIYEDDKRPSGIPDRFSGSKSGTSATLGITGLQTGDEADYFCATWDRTVNVVRFGGGTRLTVHSQPKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARHVGHELDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7156 - protein, 1077 aa, Artificial Sequence
  Synthetic Polypeptide encoding a CAR with optional accessory module(s)
MALPVTALLLPLALLLHAARPDIQMTQSPSSLSASVGDRVTITCRASQSISSYLNWYQQKPGKAPKLLIYAASSLQSGVPSGFSGSGSGTDFTLTISSLQPEDFATYYCQQSYSTPLTFGGGTKVEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCAREGKNGAFDIWGQGTMVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7157 - protein, 1102 aa, Artificial Sequence
  Synthetic Polypeptide encoding a CAR with optional accessory module(s)
MALPVTALLLPLALLLHAARPDEFDVQLVESGGGLVQPGGSLRLSCAASGFILDYYAIGWFRQAPGKEREGVLCIDASDDITYYADSVKGRFTISRDNSKNTVYLQMNSLRPEDTAVYYCATPIGLSSSCLLEYDYDYWGQGTLVTVSSLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEVQLVESGGGLVQPGGSLRLSCAASGRTYYLNAMGWFRQAPGKEREFVAAIDWSEGNKDYADSVKGRFTISRDNSKNTVYLQMNSLRPEDTAVYYCAADTPPWGPLIYIESYDSWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7158 - protein, 1077 aa, Artificial Sequence
  Synthetic Polypeptide encoding a CAR with optional accessory module(s)
MALPVTALLLPLALLLHAARPDQIVLTQSPAIMSASPGEKVTISCSASSSVSYMYWYQQKPGSSPKPWIYRTSNLASGVPARFSGSGSGTSYSLTISNMEAEDAAAYYCQQYHSYPTTFGGGTKLEVKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPKGSLKLSCAASGFSFNTYAMNWVRQAPGKGLEWIAHIRSKSNNFATYYADSVKDRFSISRDASENILFLQMNNLKTEDTAMYYCVRQGGDFPMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7159 - protein, 1076 aa, Artificial Sequence
  Synthetic Polypeptide encoding a CAR with optional accessory module(s)
MALPVTALLLPLALLLHAARPDDIQMTQSSSSFSVSLGDRVTITCMASEDIYIRLAWYQQKPGNAPRLLISAATSLETGVPSRFSGSGSGKDYTLSITSLQTEDVGTYYCQQYWSSPWTFGGGTKLEINLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEDVQLQESGPGLVKPSQSLSLTCTVTGYSITSDYTWNWIRQFPGNKLEWMGYITYSGSTSYNPSLKSRNSITRDTSKNQFFLQLNSVTTEDTATYYCARLGRRYTMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7160 - protein, 1076 aa, Artificial Sequence
  Synthetic Polypeptide encoding a CAR with optional accessory module(s)
MALPVTALLLPLALLLHAARPDIQMTQSSSSFSVSLGDRVTITCKASEDIYIRLAWYQQKPGNAPRLLISAATSLETGIPSRFSGSGSGEDYTLTITSLQTEDVATYYCQQYWTTPWTFGGGTKLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEDVQLQESGPGLVKPSQSLSLTCTVTGYSITIDYTWNWIRQFPGNKLEWMGYITYSGSTDYNPSLKSRSSITRDTSMNQFFLQLNSVTTEDTATYYCARLGRRYALDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7161 - protein, 1077 aa, Artificial Sequence
  Synthetic Polypeptide encoding a CAR with optional accessory module(s)
MALPVTALLLPLALLLHAARPDIVMTQAAPSIPVTPGESVSISCRSDKSLLHSNGNTYLFWFLQRPGQSPQLLIYRMSNLASGVPDRFSGSGSGTAFTLRISGVEAEDVGVYYCMQHLEYPYTFGGGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLQQSGPELVKPGASVKMSCKASGYAFSSSWLNWVRQRPGKGLEWIGRIYPGDGENHYNGKFKGKATLTADKSSSTGYMQLSSLTSEDSAVYFCASYYEGGYWGQGTLITVSATRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7162 - protein, 1076 aa, Artificial Sequence
  Synthetic Polypeptide encoding a CAR with optional accessory module(s)
MALPVTALLLPLALLLHAARPDIVLTQSPASLAVSLGQSVTISCRASESVEYYGTSLMQWYQQKPGQPPKLLIYGASNVESGVPARFSGSGSGTDFSLNIHPVEEDDIAMYFCQQSRKVPWTFGGGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVKLVESGGGLVKPGGSRKLSCAASGFTFSSYTMSWVRQTPAKRLEWVATISSGSSTIYYADTVKGRFTISRDNAKNTLFLQMTSLRSEDTAMYYCARRWFLDCWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7163 - protein, 1079 aa, Artificial Sequence
  Synthetic Polypeptide encoding a CAR with optional accessory module(s)
MALPVTALLLPLALLLHAARPDQVQLQQSGPGLVKPSETLSLTCTVSGDSISSYYWSWIRQPPGKGLEWIGYIYYSGSTNYNPSLKSRVTISVDTSKSQFSLKLSSVTAADTAVYYCARGRYFDVWGRGTMVTSSLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFESSYVLTQPPSVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLGAAATRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7164 - protein, 1080 aa, Artificial Sequence
  Synthetic Polypeptide encoding a CAR with optional accessory module(s)
MALPVTALLLPLALLLHAARPDIVMTQSPLSLPVTPGEPASISCRSSKSLLHSNGNTYLYWFQQKPGQAPRLLIYRMSNLASGVPDRFSGSGSGTAFTLKISRVEAEDVGVYYCMQHIEYPFTFGQGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGPEVKKPGASVKVSCKASGYTFTNSWMNWVRQRPGKGLEWIGRIYPGDGETIYNGKFRVRVTITADESTSTAYMELSSLRSEDTAVYYCARGYDDYSFAYWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7165 - protein, 1080 aa, Artificial Sequence
  Synthetic Polypeptide encoding a CAR with optional accessory module(s)
MALPVTALLLPLALLLHAARPDEIVMTQSPATLSLSPGERATLSCRASQSVSSYLAWYQQKPGQAPRLLIYDASNRATGIPARFSGSGSGTDFTLTISSLEPEDFAVYYCHQYGSSPQTFGQGTKVEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVKKPGSSVKVSCKASGGTFSSYAISWVRQAPGQGLEWMGGIIPIFGTANYAQKFQGRVTITADESTSTAYMELSSLRSEDTAVYYCAVHYGDYVFSSMDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7166 - protein, 1083 aa, Artificial Sequence
  Synthetic Polypeptide encoding a CAR with optional accessory module(s)
MALPVTALLLPLALLLHAARPDETTLTQSPGTLSLSPGERATLSCRASQSVSSSYLAWYQQKPGQAPRLLIYGASSRATGIPDRFSGSGSGTDFTLTISRLEPEDFAVYYCQQYGSSPRTFGQGTKVEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGPEYCINGVCSLDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7167 - protein, 1085 aa, Artificial Sequence
  Synthetic Polypeptide encoding a CAR with optional accessory module(s)
MALPVTALLLPLALLLHAARPDIELTQSPSSLAVSAGEKVTMSCKSSQSLLNSRTRKNQLAWYQQKPGQSPELLIYWASTRQSGVPDRFTGSGSGTDFTLTISSVQAEDLAVYYCQQSYNLLTFGPGTKLEVKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEVKLQESGGGFVKPGGSLKVSCAASGFTFSSYAMSWVRLSPEMRLEWVATISSAGGYIFYSDSVQGRFTISRDNAKNTLHLQMGSLRSGDTAMYYCARQGFGNYGDYYAMDYWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7168 - protein, 1084 aa, Artificial Sequence
  Synthetic Polypeptide encoding a CAR with optional accessory module(s)
MALPVTALLLPLALLLHAARPDIQMTQSPSSLSASVGDRVTITCRSSQNIVHSNGNTYLDWYQQTPGKAPKLLIYKVSNRFSGVPSRFSGSGSGTDFTFTISSLQPEDIATYYCFQYSHVPWTFGQGTKLQILEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLQQSGAEVKKPGSSVKVSCKASGYTFTNYYIYWVRQAPGQGLEWIGGINPTSGGSNFNEKFKTRVTITADESSTTAYMELSSLRSEDTAFYFCTRQGLWFDSDGRGFDFWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7169 - protein, 1140 aa, Artificial Sequence
  Synthetic Polypeptide encoding a CAR with optional accessory module(s)
MALPVTALLLPLALLLHAARPLFNQEVQIPLTESYCGPCPKNWICYKNNCYQFFDESKNWYESQASCMSQNASLLKVYSKEDQDLLKLVKSYHWMGLVHIPTNGSWQWEDGSILSPNLLTIIEMQKGDCALYASSFKGYIENCSTPNTYICMQRTVGGGGSGGGGDLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFELFNQEVQIPLTESYCGPCPKNWICYKNNCYQFFDESKNWYESQASCMSQNASLLKVYSKEDQDLLKLVKSYHWMGLVHIPTNGSWQWEDGSILSPNLLTIIEMQKGDCALYASSFKGYIENCSTPNTYICMQRTVGGGGSGGGGDTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7170 - protein, 1074 aa, Artificial Sequence
  Synthetic Polypeptide encoding a CAR with optional accessory module(s)
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVHLQESGPGLVKPSETLSLTCTVSDDSISSYYWSWIRQPPGKGLEWIGHISYSGSANYNPSLKSRVTISVDTSKNQFSLKLSSVTAADTAVYYCANWDDAFNIWGQGTMVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7171 - protein, 1076 aa, Artificial Sequence
  Synthetic Polypeptide encoding a CAR with optional accessory module(s)
MALPVTALLLPLALLLHAARPDVVMTQTPLTLSVTIGQPASISCKSSQSLLDSDGKTYLHWLLQRPGQSPKRLIFLVSKLDSGVPDRFTGSGSGTDFTLKISRVEAEDLGVYYCWQGTHFPQTFGGGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEVQLQESGPDLVKPSQSLSLTCTVTGYSITSGYSWHWIRQFPGNKLEWMGYIHYSGDTDYNPSLKSRFSITRDTSKNQFFLQLNSVTTEDTATYYCATPGGFVYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7172 - protein, 1078 aa, Artificial Sequence
  Synthetic Polypeptide encoding a CAR with optional accessory module(s)
MALPVTALLLPLALLLHAARPDQSELTQPRSVSGSPGQSVTISCTGTERDVGGYNYVSWYQQHPGKAPKLIIHDVIERSSGVPDRFSGSKSGNTASLTISGLQAEDEADYYCWSFAGGYYVFGTGTDVTVLLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEVQLLESGGGLVQPGGSLRLSCAASGFTFSTYQMSWVRQAPGKGLEWVSGIVSSGGSTAYADSVKGRFTISRDNSKNTLYLQMNSLRAEDTAVYYCAGELLPYYGMDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7173 - protein, 1079 aa, Artificial Sequence
  Synthetic Polypeptide encoding a CAR with optional accessory module(s)
MALPVTALLLPLALLLHAARPDQSELTQPRSVSGSPGQSVTISCTGTERDVGGYNYVSWYQQHPGKAPKLIIHDVIERSSGVPDRFSGSKSGNTASLTISGLQAEDEADYYCWSFAGGYYVFGTGTDVTVLLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGLVQPGGSLRLSCAASGFTFSTYEMHWVRQAPGKGLEWVSVILSSGGETNYADSVKGRFTISRDNSKNTLYLQMNSLRAEDTAVYYCAGMLLPYYGMDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7174 - protein, 1142 aa, Artificial Sequence
  Synthetic Polypeptide encoding a CAR with optional accessory module(s)
MQIPQAPWPVVWAVLQLGWRPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7175 - protein, 1075 aa, Artificial Sequence
  Synthetic Polypeptide encoding a CAR with optional accessory module(s)
MALPVTALLLPLALLLHAARPDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7176 - protein, 1077 aa, Artificial Sequence
  Synthetic Polypeptide encoding a CAR with optional accessory module(s)
MALPVTALLLPLALLLHAARPAIVMTQTPSPVSAAVGGTVTINCQASESVYSNNYLSWFQQKPGQPPKLLIYLASTLASGVPSRFKGSGSGTQFTLTISGVQCDDAATYYCIGGKSSSTDGNAFGGGTEVVVRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQSLEESGGRLVKPDETLTITCTVSGIDLSSNGLTWVRQAPGEGLEWIGTINKDASAYYASWAKGRLTISKPSSTKVDLKITSPTTEDTATYFCGRIAFKTGTSIWGPGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7177 - protein, 1075 aa, Artificial Sequence
  Synthetic Polypeptide encoding a CAR with optional accessory module(s)
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFTSYDVHWVRQAPGQRLEWMGWLHADTGITKFSQKFQGRVTITRDTSASTAYMELSSLRSEDTAVYYCARERIQLWFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7178 - protein, 1094 aa, Artificial Sequence
  Synthetic Polypeptide encoding a CAR with optional accessory module(s)
MALPVTALLLPLALLLHAARPDDIVMTQSPLSLPVTPGEPASISCRSSQSLLHSNGYNYLVWYLQKPGQSPQLLIYLGSIRASGVPDRFSGSGSGTDFTLKISRVEAEDVGVYYCMQPLQTPITFGQGTRLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEGLQCVAAPRWVLSQVQLQQWGAGLLKPSETLSLTCAVYGGSFSGNYWSWIRQPPGKGLEWIGEINHSGSTNYNPSLKSRVTISVDTSKNQFSLKLSSVTAADTAVYYCARGGSYNYFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7179 - protein, 1091 aa, Artificial Sequence
  Synthetic Polypeptide encoding a CAR with optional accessory module(s)
MALPVTALLLPLALLLHAARPDQLTQSPSSVSASVGDRVTITCRASRGISSWLAWYQQKPGKAPKLLIYTASSLQSGVPSRFSGSGSGTDFTLTISSLQPEDFATYYCQQAYSFPRTFGQGTKVEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEVAAPRWVLSQVQLQESGPGLVKPSQTLSLTCTVSGGSISSGGYYWIWIRQHPGKGLEWIGYIYYNGNTYYNPSLKSRVTMSVDTSKNQFSLKLSSVTAADTAVYYCARDGITMIRGYYYGMDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7180 - protein, 1065 aa, Artificial Sequence
  Synthetic Polypeptide encoding a CAR with optional accessory module(s)
MALPVTALLLPLALLLHAARPDIVVTQSPASLAVSLGQRATISYRASKSVSTSGYSYMHWNQQKPGQPPRLLIYLVSNLESGVPARFSGSGSGTDFTLNIHPVEEEDAATYYCQHIRELTRSEGGPSWKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVKLEESGGDLVKPGGSLKLSCAASGFTFSGYGMSWVRQTPDKRLEWVATISSGGSYTYYPDSVKGRFTISRDNAKNTLYLQMSSLKSEDTAMYYCARHEGGYYGSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7181 - protein, 1081 aa, Artificial Sequence
  Synthetic Polypeptide encoding a CAR with optional accessory module(s)
MALPVTALLLPLALLLHAARPDDIQMTQSPSSLSASVGDRVTITCRASQGISNYLAWYQQKTGKVPKFLIYEASTLQSGVPSRFSGGGSGTDFTLTISSLQPEDVATYYCQNYNSAPFTFGPGTKVDIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVESGGGVVQPGRSLRLSCAASGFAFSRYGMHWVRQAPGKGLEWVAVIWYDGSNKYYADSVKGRFTISRDNSKNTQYLQMNSLRAEDTAVYYCARGGDFLYYYYYGMDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7182 - protein, 1072 aa, Artificial Sequence
  Synthetic Polypeptide encoding a CAR with optional accessory module(s)
MALPVTALLLPLALLLHAARPDIQMTQSPSSLSTSVGDRVTLTCKASQDVGTAVDWYQQKPGPSPKLLIYWASTRHTGIPSRFSGSGSGTDFTLTISSLQPEDFADYYCQQYNSYPLTFGPGTKVDIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLVQSGPEVKKPGATVKISCKTSGYTFTEYTIHWVKQAPGKGLEWIGNINPNNGGTTYNQKFEDKATLTVDKSTDTAYMELSSLRSEDTAVYYCAAGWNFDYWGQGTLLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7183 - protein, 1073 aa, Artificial Sequence
  Synthetic Polypeptide encoding a CAR with optional accessory module(s)
MALPVTALLLPLALLLHAARPDIQMTQSPSSLSASVGDRVTITCKASQDIYPYLNWFQQKPGKAPKTLIYRTNRLLDGVPSRFSGSGSGTDFTFTISSLQPYYCLQYDEFPLTFGAGTKLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQITLKESGPTLVKPTQTLTLTCTFSGFSLSTSNMGVGWIRQPPGKALEWLAHIWWDDDKYYSPSLKSRLTITKDTSKNQVVLTMTNMDPVDTATYYCVRSNYGYAWFAYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7184 - protein, 1073 aa, Artificial Sequence
  Synthetic Polypeptide encoding a CAR with optional accessory module(s)
MALPVTALLLPLALLLHAARPDIVMTQSQKFMSTSVGDRVNVTCKASQNVGTNVVWYQQKTGQSPKALIHSASYRYSGVPDRFTGSGSGTDFTLTLSNVQSEDLAEYFCQHYNSFPYTFGGGTKLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLQQSGAELVRPGVSVKISCKGSGYRFTDYPIHWVKQSHAKSLEWIGIISTYYGDVTNNPKFRGKATMTVDKSSTTAYMELARLTSEDSAIYYCARNDLFAYWGQGTLVTVSATRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7185 - protein, 1076 aa, Artificial Sequence
  Synthetic Polypeptide encoding a CAR with optional accessory module(s)
MALPVTALLLPLALLLHAARPDIKMTQSPSSMYASLGERVTITCKASPDINSYLSWFQQKPGKSPKTLIYRANRLVDGVPSRFSGGGSGQDYSLTINSLEYEDMGIYYCLQYDEFPYTFGGGTKLEMKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVKLVESGGGLVKPGGSLKLSCAASGFTFSSYAMSWVRQIPEKRLEWVASISRGGTTYYPDSVKGRFTISRDNVRNILYLQMSSLRSEDTAMYYCGRYDYDGYYAMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7186 - protein, 1079 aa, Artificial Sequence
  Synthetic Polypeptide encoding a CAR with optional accessory module(s)
MALPVTALLLPLALLLHAARPDDVVVTPVSCFLSCISGAEGHHLIQGQQKCQYIWLLYALEPTETRTATQTPHLSCIQPRIWGPCQVQWQWVWDRLHPQHPSCGGGGCCNLLLSAHGAYTFGGGTRLELKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVKLQESGPELVKPGASVKMSCKASGYTFTSYVMHWVKQKPGQGLEWIGYINPYNDGTKYNEKFKGKATLTSDKSSSTAYMELSSLTSEDSAVYYCARWKIYYGNYEDYWGQGTPLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7187 - protein, 1085 aa, Artificial Sequence
  Synthetic Polypeptide encoding a CAR with optional accessory module(s)
MALPVTALLLPLALLLHAARPDEFQVQLVQSGGGLVQPGGSLRLSCAASDFDFAAYEMSWVRQAPGQGLEWVAIISHDGIDKYYTDSVKGRFTISRDNSKNTLYLQMNTLRAEDTATYYCLRLGAVGQGTLVTVSSLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGGGLVQPGGSLRLSCAASDFAFDDYEMSWVRQAPGKALEWIGDINHSGTTIYNPSLKSRVTISRDNSKNTLYLQMNTLRAEDTAIYYCARPHYGDYSDAFDIWGQGTMVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7188 - protein, 1084 aa, Artificial Sequence
  Synthetic Polypeptide encoding a CAR with optional accessory module(s)
MALPVTALLLPLALLLHAARPEIVMTQSPATLSVSPGERATLSCRASQSVSSNLAWYQQKPGQAPRLLIYGASTRATGIPARFSGSGSGTDFTLTISSLQSVDSAVYYCQQYNNWPPYTFGQGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLLESGGGVVQPGRSLRLSCAASGFTFSFYGMHWVRQAPGKGLEWVAAISYDGSNKYYADSVKGRFTISRDNSKNTLYLQMNSLRAEDTAVYYCAKRPNQFYCSDGRCYSIDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7189 - protein, 1080 aa, Artificial Sequence
  Synthetic Polypeptide encoding a CAR with optional accessory module(s)
MALPVTALLLPLALLLHAARPQSVLTQPPSASAGGTPGQRVTISCSGSSSNIGSNFVYWYQQLPGTAPKLLIYRNNQRPSGVPDRFSGSRSGTSASLAGLRSEDEADYYCAADSLGGHYVFGTGTKVLLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVESGGGSVQPGRSLRLSCEASGFTFEAYAMHWVRQPPGKGLEWVSSINWNSGRIAYADSVKGRFTISRDNARNSLYLQMNSLRLEDTAFYYCAKDIRRFSTGGAEFEYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7190 - protein, 1075 aa, Artificial Sequence
  Synthetic Polypeptide encoding a CAR with optional accessory module(s)
MALPVTALLLPLALLLHAARPENVLTQSPAIMSASPGEKVTMTCSASSSVSYMHWYQQKSSTSPKLWIYDTSKLASGVPGRFSGSGSGNSYSLTISSMEAEDVATYYCFQGSGYPLTFGAGTKLELKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLKESGPGLVAPSQSLSITCTVSGFSLSSQGVYWVRQPPGKGLEWLGAIWAGGSTNYNSALMSRLSISKDNSKSQVFLKMNSLQTDDTAMYYCARVDGYRGYNMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7191 - protein, 1086 aa, Artificial Sequence
  Synthetic Polypeptide encoding a CAR with optional accessory module(s)
MALPVTALLLPLALLLHAARPDVVMTQSPLSLPVTPGEPASISCRSSQSLLHSNGHNYLDWYLQKPGQSPQLLIYLGSNRASGVPDRFSGSGSGTDFTLKISRVEAEDVGVYYCMQTLQTPLTFGPGTKVDIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLVETGGGVVQPGRSLRLSCAASGFTFSSYGMHWVRQAPGKGLEWVAVISYDGSNKYYADSVKGRFTISRDNSKNTLYLQMNSLRAEDTAVYYCAKDRYGWGSSFGHFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7192 - protein, 1079 aa, Artificial Sequence
  Synthetic Polypeptide encoding a CAR with optional accessory module(s)
MALPVTALLLPLALLLHAARPDDIQMTQSPSSLSASVGDRVTITCRASQSISSYLNWYQQKPGKAPKLLIYDASNLETGVPSRFSGSGSGTDFTFTISSLQPEDIATYYCQQYDNLPLTFGGGTKVDIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARAHNSSSWSFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7193 - protein, 1088 aa, Artificial Sequence
  Synthetic Polypeptide encoding a CAR with optional accessory module(s)
MALPVTALLLPLALLLHAARPDDVVMTQSPLSLPVSLGDQASISCRSSQRLVHSNGNTYLHWYLQKPGQSPKLLIYRVSNRFPGVPDRFSGSGSGTDFTLKISRVEAEDLGIYFCSQSTHVPYTFGGGTKLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVRLQQSGPDLIKPGASVKMSCKASGYTFTGYVMHWVKQRPGQGLEWIGFINPYNDDIQSNERFRGKATLTSDKSSTTAYMELSSLTSEDSAVYYCARGAGYNFDGAYRFFDFWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7194 - protein, 1079 aa, Artificial Sequence
  Synthetic Polypeptide encoding a CAR with optional accessory module(s)
MALPVTALLLPLALLLHAARPDSYELTQPPSVSVSPGQTATISCSGDQLGGKYGHWYQKKPGQSPVLVLYQDRKRPAGIPERFSGSSSGNTITLTISGTQAVDEADYYCQAWDTNLGGVFGGGTKVTVLGQLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVESGAEVKKPGASVKVSCKASGYTFTGYYMHWVRQAPGQGLEWMGRINPNSGGTNYAQKFQGRVTMTRDTSISTAYMELSRLRSDDTAVYYCASPRGRGSAFDIWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7195 - protein, 1082 aa, Artificial Sequence
  Synthetic Polypeptide encoding a CAR with optional accessory module(s)
MALPVTALLLPLALLLHAARPDNFMLTQPHSVSESPGKTVTISCTRSSGSIASKYVQWYQQRPGSSPTTVIYEDNQRPSGVPDRFSGSIDTSSNSASLTISGLRTEDEADYYCHSYDSNNHSVFGGGTKVTVLGQLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGVVQPGGSLRLSCAASGFTFSSYAMSWVRQAPGKGLEWVSAISGSGGSTYYADSVKGRFSISRDNSKNTLYLQMNSLRAEDTAVYYCARTRSSGAFDIWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7196 - protein, 1077 aa, Artificial Sequence
  Synthetic Polypeptide encoding a CAR with optional accessory module(s)
MALPVTALLLPLALLLHAARPDIQMNQSPSSLSASLGDTITITCHASQNINVWLSWYQQKPGNIPKLLIYKASNLHTGVPSRFSGSGSGTGFTITISSLQPEDIATYYCQQGQSYPWTFGGGTKLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLQQSGPELVKPGASVKISCKASGYSFTGYFMNWVKQSHGKSLEYIGRFNPYNGETLYNQKFKGKATLTVDKSSSTVHMELLSVTSEDSAVYYCGRSGNDDAMDYWGQGTSVTVSSATRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7197 - protein, 1078 aa, Artificial Sequence
  Synthetic Polypeptide encoding a CAR with optional accessory module(s)
MALPVTALLLPLALLLHAARPDDIQMTQSPSILSASVGDRVTITCRASQRFGDYLAWYQQKPGQAPKLLIYGASTLQSGVPSRFSGSGSGTEFTLTISGLQPEDFATYYCQQANSFPITFGKGTRLDIRRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKVSCKASGGTFSSYAISWVRQAPGQGLEWMGWINVGNGNAIYSQKFQGRVTITRDTSATTAYMELSSLRSEDTAVYYCARDGERAWDLDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7198 - protein, 1083 aa, Artificial Sequence
  Synthetic Polypeptide encoding a CAR with optional accessory module(s)
MALPVTALLLPLALLLHAARPDETTLTQSPGTLSLSPGERATLSCRASQSVSSSYLAWYQQKPGQAPRLLIYGASSRATGIPDRFSGSGSGTDFTLTISRLEPEDFAVYYCQQYGSSPYTFGQGTKLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGGGVVQPGRSLRLSCAASGFTFSSYAMHWVRQAPGKGLEWVAVISYDGSNKYYADSVKGRFTISRDNSKNTLYLQMNSLRAEDTAVYYCARELRFLEWSSDAFDIWGQGTMVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7199 - protein, 1078 aa, Artificial Sequence
  Synthetic Polypeptide encoding a CAR with optional accessory module(s)
MALPVTALLLPLALLLHAARPEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTMIRGVIDSWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7200 - protein, 1087 aa, Artificial Sequence
  Synthetic Polypeptide encoding a CAR with optional accessory module(s)
MALPVTALLLPLALLLHAARPDIVMTQTPLSLPVTPGEPASISCRSSRSLLDSDDGNTYLDWYLQKPGQSPQLLIYTLSYRASGVPDRFSGSGSGTDFTLKISRVEAEDVGVYYCMQRVEFPITFGQGTRLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVESGGGVVQPGRSLRLSCAASGFIFSRYGMHWVRQAPGKGLKWVAVIWYDGSNKLYADSVKGRFTISRDNSKNTLYLQMNSLRAEDTAVYYCARDYYDNSRHHWGFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7201 - protein, 1077 aa, Artificial Sequence
  Synthetic Polypeptide encoding a CAR with optional accessory module(s)
MALPVTALLLPLALLLHAARPEIQMTQSPSSMSASLGDTITITCQATQDIFKNLNWYQQKPGKPPSLLIYYATELAEGVPSRFSGSGSGSDYSLTISNLESEDFAAYYCLQFFEFPFTFGSGTKLEMKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLQQSGAELVRPGTSVKVSCKASGYVFTNYWIEWIKQRPGQGLEWIGVMNPGSGETTYNEKFKGKATLTADKSSSTAYMQLSSLTSVDSAVYFCARDHDRDYYAMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7202 - protein, 1074 aa, Artificial Sequence
  Synthetic Polypeptide encoding a CAR with optional accessory module(s)
MALPVTALLLPLALLLHAARPDILLTQSPAILSVSPGERVSFSCRASQNIGTSIHWYQQRTNGSPRLLIKYASESVSGIPSRFSGSGSGTDFTLSINSVESEDIADYYCQHTNSWPTTFGGGTKLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLQQSDAELVKPGASVKISCKASGYTFTDHAIHWVKQKPEQGLEWIGYFSPGNGDIKYNEKFKGKATLTADKSSSTAYMQLNSLTSEDSAVYFCKRSYGNYDYWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7203 - protein, 1079 aa, Artificial Sequence
  Synthetic Polypeptide encoding a CAR with optional accessory module(s)
MALPVTALLLPLALLLHAARPDIVMTQSPDSLAVSLGERATINCKSSQSLLNSGDQKNYLTWYQQKPGQPPKLLIYWASTRESGVPDRFSGSGSGTDFTLTISSLQAEDVAVYYCQNDYSYPLTFGQGTKVEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKTGSSVKVSCKASGYTFTDHAIHVWRQAPGQALEWMGHFSPGNTDIKYNDKFKGRVTLTVDRSMSTAYMELSSLRSEDTAMYYCKTSTFFFDYWGQGTMVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7204 - protein, 1078 aa, Artificial Sequence
  Synthetic Polypeptide encoding a CAR with optional accessory module(s)
MALPVTALLLPLALLLHAARPDIQMTQSPSSLSASVGDRVTITCKASQDVSIAVAWYQQKPGKAPKVLIYSASYRYTGVPDRFSGSGSGTDFTFTISSLQPEDIAVYYCQQHYITPLTFGGGTKVEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQIQLVQSGHEVKKPGASVKVSCKASGYTFTNYGMNWVRQAPGQGLEWMGWINTKTGEPTYAEEFKGRFVFSLETSASTAYLQISSLKAEDTAMYFCGRGGYGSSYWYFDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7205 - protein, 1080 aa, Artificial Sequence
  Synthetic Polypeptide encoding a CAR with optional accessory module(s)
MALPVTALLLPLALLLHAARPDIVMTQSPDSLAVSLGERATINCRASKSVSTSGYSYMHWYQQKPGQPPKLLIYLASNLESGVPDRFSGSGSGTDFTLTISSLQAEDVAVYYCQHSRELPYTFGQGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSETLSLTCTVSGGSISSYGVHWIRQPPGKGLEWIGVIWTSGVTDYNSALMGRVTISVDTSKNQFSLKLSSVTAADTAVYYCARDGDYDRYTMDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7206 - protein, 1059 aa, Artificial Sequence
  Synthetic Polypeptide encoding a CAR with optional accessory module(s)
MTALFLMSMLFGLACGQAMSFCIPTEYTMHIERRECAYCLTINTTICAGYCMTRDINGKLFLPKYALSQDVCTYRDFIYRTVEIPGCPLHVAPYFSYPVALSCKCGKCNTDYSDCIHEAIKTNYCTKPQKSYLVGFSVLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEAPDVQDCPECTLQENPFFSQPGAPILQCMGCCFSRAYPTPLRSKKTMLVQKNVTSESTCCVAKSYNRVTVMGGFKVENHTACHCSTCYYHKSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7207 - protein, 1076 aa, Artificial Sequence
  Synthetic Polypeptide encoding a CAR with optional accessory module(s)
MALPVTALLLPLALLLHAARPQSVLTQPPSVSVSPGQTASITCSGDKLGDKYACWYQQKPGQSPVLVIYQDSKRPSGIPERFSGSNSGNTATLTISGTQAMDEADYYCQAWDSSTAVVFGGGTKLTVLLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGQSLKISCKASGYSLTDNWIGWVRQKPGKGLEWMGIIYPGDSDTRYSPSFQGQVTISADKSINTAYLQWSSLKASDTAIYYCVGLDWNYNPLRYWGPGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7208 - protein, 1074 aa, Artificial Sequence
  Synthetic Polypeptide encoding a CAR with optional accessory module(s)
MALPVTALLLPLALLLHAARPDIVMTQSQKFMSTSVGDRVSIICKASQNVGTFVAWYQQKPGQSPKLLVYSASNRYTGVPDRFTGSGSGTDFTLTINNMQSEDLADYFCRQYSSYPYTFGGGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLQQSGPELVKPGASMKISCKASGYSFSAYTMNWVKQSHGKNLEWIGLINPYNGGTNYNQEFEGKATLTVNKSSNTAFMELLSLTSDDSAVYYCARRDWDYFDYWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7209 - protein, 1085 aa, Artificial Sequence
  Synthetic Polypeptide encoding a CAR with optional accessory module(s)
MALPVTALLLPLALLLHAARPAIQMTQSPSSLSASVGDRVTITCRASQSISNYLNWYQQKPGKAPKLLIYAASSLQSGVPSRFSGSGSGTDFTLTISSLQPEDFATYYCQQSYSSPSTTFGQGTKLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLIQPGGSLRLSCAASGFTVSSNYMSWVRQAPGKGLEWVSVTYSGGSTSYADSVKGRFTISRDNSKNTLYLQMNSLRAEDTAVYYCARGGRYCSSISCYARSGCDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7210 - protein, 1080 aa, Artificial Sequence
  Synthetic Polypeptide encoding a CAR with optional accessory module(s)
MALPVTALLLPLALLLHAARPDIQMTQSPSSLSASVGDRVTITCRASQSIGTSLHWYQQKPGKAPKLLIKFASRLQSGVPSRFSGSGSGTDFTLTISSLQPEDFATYYCQQSPGFPPTFGQGTKLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVESGGGLVKPGGSLRLSCAASGFSITTSGYYWTWIRQFPGKGLEWMGYIGYNSKTYYNPALKSRITISRDNAKNSLYLQMNSLRAEDTAVYYCARSLYGGYKDAFDSWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7211 - protein, 1085 aa, Artificial Sequence
  Synthetic Polypeptide encoding a CAR with optional accessory module(s)
MALPVTALLLPLALLLHAARPDEIVLTQSPLSLPVTPGEPASISCRSSQSLLHSIGYNYLDWYLQKPGQSPQLLIYLGSNRASGVPDRFSGSGSGTDFTLKISRVEAEDVGVYYCMQALQTPLTFGGGTKVEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGVVQPGRSLRLSCAASGFTFRSYGMHWVRQAPGKGLEWVAVISYDGSNKYYTDSVNGRFTISRDNSKNTLYLQMNSLRAEDTAVYYCARGGGYYETSGPDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7212 - protein, 1083 aa, Artificial Sequence
  Synthetic Polypeptide encoding a CAR with optional accessory module(s)
MALPVTALLLPLALLLHAARPDDVVMTQSPLSLPVTPGEPASISCRSSQSLLHSIGYNYLHWFLQKPGQSPQLLIYLGSNRASGVPDRFSGSGSGTDFTLKISRVEAEDVGVYYCMQALQTPPTFGQGTRLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQLQLQESGPGLVKPSGTLSLTCAVSGGSISSSNWWSWVRQPPGKGLEWIGEIYHSGSTNYNPSLKSRVTISVDKSKNQFSLKLSSVTAADTAVYYCVGSPYGDYVLDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7213 - protein, 1085 aa, Artificial Sequence; identical to SEQ ID NO: 7211
  Synthetic Polypeptide encoding a CAR with optional accessory module(s)

SEQ ID NO: 7214 - protein, 1081 aa, Artificial Sequence
  Synthetic Polypeptide encoding a CAR with optional accessory module(s)
MALPVTALLLPLALLLHAARPDEIVLTQSPGTLSLSLGERATLSCRASQSISSSFLAWYQQKPGQAPKLLIYAASTRATGIPDRFSGSGSGTDFTLTISRLEPEDFAVYYCQQYGRSLSFGGGTKVEVKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLQQSGPGLVKPSQTLSLTCAISGDSVSGNSATWNWIRQSPSRGLEWLGRTYYRSKWNHDYAESVKSRITINPDTSKNQFSLQLNSVTPEDTAVYYCARGDSSSWYAFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7215 - protein, 1081 aa, Artificial Sequence
  Synthetic Polypeptide encoding a CAR with optional accessory module(s)
MALPVTALLLPLALLLHAARPDQTVVTQPPSASGTPGQRVTISCSGSSSNIGSNYVYWYQQLPGTAPKLLIYRSNQRPSGVPDRFSGSKSGTSASLAISGPRSVDEADYYCAAWDDSLNGVVFGGGTKLTVLGLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARRIPPYYGMDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7216 - protein, 1080 aa, Artificial Sequence
  Synthetic Polypeptide encoding a CAR with optional accessory module(s)
MALPVTALLLPLALLLHAARPDQSVVTQPPSVSVAPGKTARITCGRNNIGSKSVHWYQQKPGQAPVLVVYDDSDRPSGIPERFSGSNSGNTATLTISRVEAGDEADYYCQVWDSSSDHVVFGGGTKLTVLGLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEVQLVQSGGGVMRPGGSLRLSCAASGFTFDDYGMSWVRQAPGKGLEWVSGINWNGGSTGYADSVRGRFTISRDNAKNSLYLQMNSLRAEDTALYYCARERGYGYHDPHDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7217 - protein, 1093 aa, Artificial Sequence
  Synthetic Polypeptide encoding a CAR with optional accessory module(s)
MALPVTALLLPLALLLHAARPEQKLISEEDLEFQAVVTQPPSASGTPGQRVTISCSGSSSNIGSNTVNWYQQVPGTAPKLLIYSNNQRPSGVPDRFSGSKSGTSASLAISGLQSEDEADYYCAAWDDSLNGWVFGGGTKLTVLLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQMQLVQSGAEVKEPGESLRISCKGSGYSFTNFWISWVRQMPGKGLEWMGRVDPGYSYSTYSPSFQGHVTISADKSTSTAYLQWNSLKASDTAMYYCARVQYSGYYDWFDPWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7218 - protein, 1087 aa, Artificial Sequence
  Synthetic Polypeptide encoding a CAR with optional accessory module(s)
MALPVTALLLPLALLLHAARPEQKLISEEDLEFDIQMTQSPSTLSASVGDRVTITCRASQNINKWLAWYQQRPGKAPQLLIYKASSLESGVPSRFSGSGSGTEYTLTISSLQPDDFATYYCQQYNSYATFGQGTKVEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGESLKISCKGSGYNFSNKWIGWVRQLPGRGLEWIAIIYPGYSDITYSPSFQGRVTISADTSINTAYLHWHSLKASDTAMYYCVRHTALAGFDYWGLGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7219 - protein, 1079 aa, Artificial Sequence
  Synthetic Polypeptide encoding a CAR with optional accessory module(s)
MALPVTALLLPLALLLHAARPDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7220 - protein, 1078 aa, Artificial Sequence
  Synthetic Polypeptide encoding a CAR with optional accessory module(s)
MALPVTALLLPLALLLHAARPDEIVLTQSPGTLSLSPGERATLSCRASQSVSNTYLAWYHQRPGQAPRLLIYGASSRATGIPDRFSGSGSGTDFALTISSLEPEDFAVYYCQQYSNSWTFGQGTKVEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVESGGGVVQPGRSLRLSCAASGFTFSSYDMHWVRQAPGKGLEWVAVISYDGTNEYYADSVKGRFTISRDTSKNTLYLQMNSLRAEDTAVYYCARERYFDWSFDYWGQGTLVSVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7221 - protein, 1077 aa, Artificial Sequence
  Synthetic Polypeptide encoding a CAR with optional accessory module(s)
MALPVTALLLPLALLLHAARPDELTQDPAVSVALGQTVRITCQGDSLRSNYANWYQQKPGQAPVLVIYGQNNRPSGIPDRFSGSSSGNTASLTITGAQAADEADYYCDSRVSTGNHVVFGGGTKLTVLGQLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVKKPGASVKVSCKASGYTFTSYAMHWVRQAPGQRLEWMGWINAGNGNTKYSQKFQGRVTITRDTSASTAYMELSSLRSEDTAVYYCARDISYGSFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7222 - protein, 1079 aa, Artificial Sequence
  Synthetic Polypeptide encoding a CAR with optional accessory module(s)
MALPVTALLLPLALLLHAARPDDIVLTQTPATLSVTPGDSVSLSCRASQSISNNLHWYQQKSHESPRLLIKNASQSISGIPSKFSGSGSGTDFTLRINSVETEDFGMYFCQQSNSWPYTFGSGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVKLQQSGPELVKPGASVKISCKASGYSFTGYYMHWVKQSHGNILDWIGYIYPYNGVSSYNQKFKGKATLTVDKSSSTAYMELRSLTSEDSAVYYCARERGLYQLRAMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7223 - protein, 1070 aa, Artificial Sequence
  Synthetic Polypeptide encoding a CAR with optional accessory module(s)
MALPVTALLLPLALLLHAARPDDIVMTQTPAIMSASPGQKVTITCSASSSVNYMHWYQQKLGSSPKLWIYDTSKLAPGVPARFSGSGSGTSYSLTISSMEAEDAASYFCHQWSSYPYTFGSGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLQESGPDLVKPSQSLSLTCTVTGYSITSGYGWHWIRQFPGNKLEWMGYIHYSGSTTYNPSLKSRISISRDTSKNQFFLQLNSVTTEDTATYYCARSLRYWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7224 - protein, 1073 aa, Artificial Sequence
  Synthetic Polypeptide encoding a CAR with optional accessory module(s)
MALPVTALLLPLALLLHAARPDDIQMTQSPSSLSASVGDRVTITCSATSSISYMHWYQQKPGKAPKGWIYDTSKLAHGVPSRFSGSGSGTDFTLTISSLQPEDFATYYCHQRRSYPFTFGQGTKVEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVKKPGASVKVSCKASGYTFTNFWIHWVRQAPGQGLEWIGEIDPSDSYTNYNQKFKGRVTITRDTSTSTAYLELSSLRSEDTAVYYCAREITTVDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7225 - protein, 1080 aa, Artificial Sequence
  Synthetic Polypeptide encoding a CAR with optional accessory module(s)
MALPVTALLLPLALLLHAARPDDIQMTQSPSSLSASVGDRVTITCKASQGFNKYVAWYQQKPGKAPKLLIYYTSTLQPGVPSRFSGSGSGRDYTLTISSLQPEDFATYYCLQYGNLLYAFGQGTKVEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVKKPGASVKVSCKASGYTFTSYWIGWVRQAPGQGLEWIGDIYPGGGYTNYNEKFKGRVTITRDTSTSTAYLELSSLRSEDTAVYYCARLDGSSYRGAMDSWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7226 - protein, 1084 aa, Artificial Sequence
  Synthetic Polypeptide encoding a CAR with optional accessory module(s)
MALPVTALLLPLALLLHAARPDDIQLTQSPSSLSASVGDRVTITCRASQSVDYDGDSYMNWYQQKPGKAPKLLIYAASYLESGVPSRFSGSGSGTDFTLTISSLQPEDFATYYCQQSHEDPYTFGQGTKVEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAVSGYSITSGYSWNWIRQAPGKGLEWVASITYDGSTNYNPSVKGRITISRDDSKNTFYLQMNSLRAEDTAVYYCARGSHYFGHWHFAVWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7227 - protein, 1076 aa, Artificial Sequence
  Synthetic Polypeptide encoding a CAR with optional accessory module(s)
MALPVTALLLPLALLLHAARPDDIQMTQSPSSLSASVGDRVTITCRASQDIRYYLNWYQQKPGKAPKLLIYVASSLQSGVPSRFSGSGSGTEFTLTVSSLQPEDFATYYCLQVYSTPRTFGQGTKVEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLAKPGGSLRLSCAASGFRFTFNNYYMDWVRQAPGQGLEWVSRISSSGDPTWYADSVKGRFTISRENAKNTLFLQMNSLRAEDTAVYYCASLTTGSDSWGQGVLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7228 - protein, 1076 aa, Artificial Sequence
  Synthetic Polypeptide encoding a CAR with optional accessory module(s)
MALPVTALLLPLALLLHAARPEIVMTQSPATLSVSPGERATLSCRASQSVSRNLAWYQQKPGQAPRLLIYGASTRATGIPARFSGSGSGTEFTLTIGSLQSEDFAVYYCQQYKTWPRTFGQGTNVEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLQQWGAGLLKPSETLSLTCAVFGGSFSGYYWSWIRQPPGKGLEWIGEINHRGNTNDNPSLKSRVTISVDTSKNQFALKLSSVTAADTAVYYCARERGYTYGNFDHWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7229 - protein, 1077 aa, Artificial Sequence
  Synthetic Polypeptide encoding a CAR with optional accessory module(s)
MALPVTALLLPLALLLHAARPEIVMTPSSATLSVSPGERATLSCRASQSVSRNLAWYQQKPGQAPRLLIYGASTRATGIPARFSGSGSGTEFTLTISSLQSEDFAVYYCHQYSNWMCSFGQGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGLVQPGGSLRLSCAASGFTFSRYAMNWVRQAPGKGLEWVSGISGSGGRTYYADSVKGRFTISRDNSKNTLYLQMNSLRAEDTAVYYCAKDRDFWSGPFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7230 - protein, 1082 aa, Artificial Sequence
  Synthetic Polypeptide encoding a CAR with optional accessory module(s)
MALPVTALLLPLALLLHAARPDIQMTQSPSSLSASVGDRVTITCKASKNIRSYLAWYQQKPGKAPKLLIYSGSTLHSGVPSRFSGSGSGTDFTLTISSLQPEDFATYYCQQHHEYPLTFGQGTKVEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSETLSLTCTVSGYTITSGYDWSWIRQPPGKGLEWIGYINYGGSTNYKPSLGSRVTISVDTSKNQFSLKLSSVTAADTAVYYCARYNEYKSYIYDWYFDFWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7231 - protein, 1105 aa, Artificial Sequence
  Synthetic Polypeptide encoding a CAR with optional accessory module(s)
MALPVTALLLPLALLLHAARPELVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEGEINHRGNTNDNPSLKSRVTISVDTSKNQFALKLSSVTAADTAVYYCARERGYTYGNFDHWGQGTLVTVSSGEINHRGNTNDNPSLKSRVTISVDTSKNQFALKLSSVTAADTAVYYCARERGYTYGNFDHWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7232 - protein, 1080 aa, Artificial Sequence
  Synthetic Polypeptide encoding a CAR with optional accessory module(s)
MALPVTALLLPLALLLHAARPSSELTQDPAVSVALGQTVRITCQGDSLRSYYASWYQQKPGQAPVLVIYGKNNRPSGIPDRFSGSSSGNTASLTITGAQAEDEADYYCNSRDSSGWVFGGGTKLTVLLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDKGGGYYDFWSGSDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7233 - protein, 1089 aa, Artificial Sequence
  Synthetic Polypeptide encoding a CAR with optional accessory module(s)
MALPVTALLLPLALLLHAARPQSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLVYVFGTGTKVTVLLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLQQSGPGLVKPSQTLSLTCAISGDSVLSNSDTWNWIRQSPSRGLEWLGRTYHRSTWYDDYASSVRGRVSINVDTSKNQYSLQLNAVTPEDTGVYYCARDRLQDGNSWSDAFDVWGQGTMVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7234 - protein, 1082 aa, Artificial Sequence
  Synthetic Polypeptide encoding a CAR with optional accessory module(s)
MALPVTALLLPLALLLHAARPQSVLTQPRSVSGSPGQSVTISCTGTSSDVGGYNYVSWYQQHPGEAPKLIIYDADKRPSGISNRFSSGKSGNTASLTISGLQVEDEADYYCCSYAGGSTWVFGGGTKVTVLLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARGDSNYWSYYGMDVWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7235 - protein, 1089 aa, Artificial Sequence
  Synthetic Polypeptide encoding a CAR with optional accessory module(s)
MALPVTALLLPLALLLHAARPQSALTQPASVSGSPGQSITISCTGTSSDVGGYNYVSWYQQHPGKAPKVIISEVNNRPSGVSHRFSGSKSGNTASLTISGLQAEDEADYFCSSYTSGRTLYVFGTGSKVTVLGLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLQQSGPGLVKPSQTLSLTCAISGDSVSSNSAAWNWIRQSPSRGLEWLGRTYYRSKWYSDYAVSVKSRITINPDTSKNQFSLQLNSVTPEDTAVYYCARDPYDFWSGYPDAFDIWGQGTMVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7236 - protein, 1088 aa, Artificial Sequence
  Synthetic Polypeptide encoding a CAR with optional accessory module(s)
MALPVTALLLPLALLLHAARPEVQLQQSGPGLVKPSQTLSLTCAISGDSMLSNSDTWNWIRQSPSRGLEWLGRTYHRSTWYDDYASSVRGRVSINVDTSKNQYSLQLNAVTPEDTGVYYCARVRLQDGNSWSDAFDVWGQGTMVTVSSLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQSALTQPASASGSPGQSVTISCTGTSSDVGGYNYVSWYQQHPGKAPKLMIYDVSNRPSGVSNRFSGSKSGNTASLTISGLQAEDEADYYCSSYTSSSTLYVFGTGTQLTVLTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 7237 - protein, 1126 aa, Artificial Sequence
  Synthetic Polypeptide encoding a CAR with optional accessory module(s)
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7238 - protein, 1127 aa, Artificial Sequence
  Synthetic Polypeptide encoding a CAR with optional accessory module(s)
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7239 - protein, 1128 aa, Artificial Sequence
  Synthetic Polypeptide encoding a CAR with optional accessory module(s)
MALPVTALLLPLALLLHAARPDEIVLTQSPATLSLSPGERATLSCSASSSVSYMHWYQQKPGQAPRLLIYDTSKLASGIPARFSGSGSGTDFTLTISSLEPEDVAVYYCFQGSVYPFTFGQGTKLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLQESGPGLVKPSQTLSLTCTVSGGSISTSGMGVGWIRQHPGKGLEWIGHIWWDDDKRYNPALKSRVTISVDTSKNQFSLKLSSVTAADTAVYYCARMELWSYYFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7240 - protein, 1135 aa, Artificial Sequence
  Synthetic Polypeptide encoding a CAR with optional accessory module(s)
MALPVTALLLPLALLLHAARPDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7241 - protein, 1134 aa, Artificial Sequence
  Synthetic Polypeptide encoding a CAR with optional accessory module(s)
MALPVTALLLPLALLLHAARPDIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7242 - protein, 1126 aa, Artificial Sequence
  Synthetic Polypeptide encoding a CAR with optional accessory module(s)
MALPVTALLLPLALLLHAARPDYIHVTQSPSSLSVSIGDRVTINCQTSQGVGSDLHWYQHKPGRAPKLLIHHASSVEDGVPSRFSGTGFHTSFNLTINDLQADDIGTYYCQVLQSFGRGSRLDTKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFERAHLVQSGTAMKKPGASVRVSCQTSGYTFTAHILFWFRQAPGRGLEWVGWIKPQYGAVNFGGGFRDRVTLTRDVYREIAYMDIRGLKPDDTAVYYCARDRSYGDSSWALDAWGQGTTVVVSATRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7243 - protein, 1136 aa, Artificial Sequence
  Synthetic Polypeptide encoding a CAR with optional accessory module(s)
MALPVTALLLPLALLLHAARPDVQMIQTPDSLAVSLGQRATISCRASESVDNYGISFMHWYQQKPGQSPKLLIYRASNLESGIPARFSGSGSRTDFTLTINPVETDDVATYYCQQNNKDPPTFGGGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEGGGGSQVQLQQSGAELVKPGASVKISCKASGYAFSSYWMNWVKQRPGKGLEWIGQIYPGDGDTTYNGKFKGKATLTADKSSSTVYMQLNSLTSEDSAVYFCVRYYYGSSGYFDYWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7244 - protein, 1127 aa, Artificial Sequence
  Synthetic Polypeptide encoding a CAR with optional accessory module(s)
MALPVTALLLPLALLLHAARPDVQMIQTPSSLSASLGDRVTISCRASQDIGNYLNWYQQKPDGTVKLLIYYTSRLHSGVPSRFSGSGSGTEYSLTISNLEQEDIATYFCQQGSALPPTFGGGTKLEINLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEALQLQQSGAELVRPGASVTLSCKASGYTFTDYEMHWVKQTPVHGLEWIGAIDPETGGTAYNQKFEGKAILTADKSSSTAYMELRSLTSEDSPVYYCARRRYYGSSSFDYWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7245 - protein, 1134 aa, Artificial Sequence
  Synthetic Polypeptide encoding a CAR with optional accessory module(s)
MRLPAQLLGLLMLWVSGSSGDVVMTQSPLSLPVTPGAPASISCRSSQSIVHSNGNTYLEWYLQKPGQSPKLLIYKVSNRFSGVPDRFSGSGSGTDFTLRISRVEAEDVGIYYCFQGSHVPPTFGPGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLVESGGGLVQPGGSLRLSCSASGFTFSSFGMHWVRQAPGKGLEWVAYISSGSSTIYYGDTVKGRFTISRDNAKNSLFLQMSSLRAEDTAVYYCAREGGYYYGRSYYTMDYWGQGTTVTVSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7246 - protein, 1448 aa, Artificial Sequence
  Synthetic Polypeptide encoding a CAR with optional accessory module(s)
MALPVTALLLPLALLLHAARPARKRTQPTFGFTVNWKFSESTTVFTGQCFIDRNGKEVLKTMWLLRSSVNDIGDDWKATRVGINIFTRLRTQKEGGSGGSARKCSLTGKWTNDLGSNMTIGAVNSRGEFTGTYITAVTATSNEIKESPLHGTQNTINKSGGSTTVFTGQCFIDRNGKEVLKTMWLLRSSVNDIGDDWKATRVGINIFTRLRTQKEGGSGGSARKCSLTGKWTNDLGSNMTIGAVNSRGEFTGTYITAVTATSNEIKESPLHGTQNTINKRTQPTFGFTVNWKFSELEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEARKRTQPTFGFTVNWKFSESTTVFTGQCFIDRNGKEVLKTMWLLRSSVNDIGDDWKATRVGINIFTRLRTQKEGGSGGSARKCSLTGKWTNDLGSNMTIGAVNSRGEFTGTYITAVTATSNEIKESPLHGTQNTINKSGGSTTVFTGQCFIDRNGKEVLKTMWLLRSSVNDIGDDWKATRVGINIFTRLRTQKEGGSGGSARKCSLTGKWTNDLGSNMTIGAVNSRGEFTGTYITAVTATSNEIKESPLHGTQNTINKRTQPTFGFTVNWKFSETRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7247 - protein, 1131 aa, Artificial Sequence
  Synthetic Polypeptide encoding a CAR with optional accessory module(s)
MALPVTALLLPLALLLHAARPDIVLTQSPASLAVSLGQRATISCRASKSVSTSGYSYLHWYQQKPGQPPKLLIYLASNLESGVPARFSGSGSGTDFTLNIHPVEEEDAATYYCQHSRELPFTFGSGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLVESGGGLVQPGGSLKLSCAASGFDFSRYWMSWVRQAPGKGLEWIGEINPTSSTINFTPSLKDKVFISRDNAKNTLYLQMSKVRSEDTALYYCARGNYYRYGDAMDYWGQGTSVTVSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7248 - protein, 1129 aa, Artificial Sequence
  Synthetic Polypeptide encoding a CAR with optional accessory module(s)
MALPVTALLLPLALLLHAARPDIQMTQSPSSLSASVGDRVTITCSASQDISNYLNWYQQKPGKAPKLLIYYTSNLHSGVPSRFSGSGSGTDFTLTISSLQPEDFATYYCQQYRKLPWTFGQGTKLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLVQSGAEVKKPGSSVKVSCKASGGTFSNYWMHWVRQAPGQGLEWMGATYRGHSDTYYNQKFKGRVTITADKSTSTAYMELSSLRSEDTAVYYCARGAIYDGYDVLDNWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7249 - protein, 1129 aa, Artificial Sequence
  Synthetic Polypeptide encoding a CAR with optional accessory module(s)
MALPVTALLLPLALLLHAARPDIVLTQSPATLSLSPGDRATISCRASESVTILGSHLIYWYQQKPGQPPRLLIQLASNVQTGVPARFSGSGSRTDFTLTISSVEPEDFAVYYCLQSRTIPRTFGQGTKLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLVQSGPEVKKPGESVKISCKASGYTFRHYSMNWVKQAPGQGLKWMGRINTESGVPIYADDFKGRFSFTVDTSASTAYLEISSLTSEDTAVYFCSNDYLYSLDFWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7250 - protein, 1128 aa, Artificial Sequence
  Synthetic Polypeptide encoding a CAR with optional accessory module(s)
MALPVTALLLPLALLLHAARPQSVLTQPPSVSGAPGQRVTISCTGSSSNIGAGFDVHWYQQLPGTAPKLLIYGNSNRPSGVPDRFSGSKSGTSASLAITGLQAEDEADYYCQSYDSSLSGYVFGTGTKVTVLGLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLVQSGAEVKKPGASVKVSCKASGYTFTDYYMHWVRQAPGQRLEWMGWINPNSGGTNYAQKFQDRITVTRDTSSNTGYMELTRLRSDDTAVYYCARSPYSGVLDKWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7251 - protein, 1127 aa, Artificial Sequence
  Synthetic Polypeptide encoding a CAR with optional accessory module(s)
MALPVTALLLPLALLLHAARPQAVLTQPPSASGTPGQRVTISCSGSSSNIGSYTVSWYQQLPGTAPKFLIYSNNQRPSGVPDRFSGSKSGTSASLAISGLQSEDEADYYCAAWDDSLNGYVFGTGTKVTVLGLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEVQLVQSGAEVKKPGESLKISCKGSGYDFTTYWIGWVRQMPGKGLEWMGIIYPGDSDTRYSPSVRGRVTISADKSINTAYLQWSSLEASDTAMYYCARMWTFSQDGWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7252 - protein, 1130 aa, Artificial Sequence
  Synthetic Polypeptide encoding a CAR with optional accessory module(s)
MALPVTALLLPLALLLHAARPDIVMTQSPDSLAVSLGERATINCKSSQSILYSSNQKNYLAWYQQKPGQSPKLLIYWASTRESGVPDRFSGSGSGTDFTLTISSLQAEDVAVYYCHQYISSYTFGQGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLVQSGAEVKKPGASVKVSCKASGYTFASQWMHWMRQAPGQGLEWIGWINPGNVNTKYNEKFKGRATLTVDTSTNTAYMELSSLRSEDTAVYYCARSTWYRPLDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7253 - protein, 1254 aa, Artificial Sequence
  Synthetic Polypeptide encoding a CAR with optional accessory module(s)
MVRGVPFRHLLLVLQLALLPAATQGKKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEIYQELTQLKAAVERLCHPCPWEWTFFQGNCYFMSNSQRNWHDSITACKEVGAQLVVIKSAEEQNFLQLQSSRSNRFTWMGLSDLNQEGTWQWVDGSPLLPSFKQYWNRGEPNNVGEEDCAEFSGNGWNDDKCNLAKFWICKKSAASCSRDEEQFLSPAPATPNPPPATRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7254 - protein, 1130 aa, Artificial Sequence
  Synthetic Polypeptide encoding a CAR with optional accessory module(s)
MALPVTALLLPLALLLHAARPDHIVLTQSPSSLSASLGDRVTISCRASQDISTYLNWYQQKPDGTVKLLIFYTSRLHAGVPSRFSGSGSGTHHSLTISNLEQEDIATYFCQQGNSLPFTFGSGTKLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLKESGPELEKPGASVKISCKASGYSFTAYSMNWVKQNNGMSLEWIGSIDPYYGDTKYAQKFKGKATLTVDKASSTAYLQLKSLTSEDSAVYYCARRMITTGDWYFDVWGAGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7255 - protein, 1130 aa, Artificial Sequence; identical to SEQ ID NO: 7254
  Synthetic Polypeptide encoding a CAR with optional accessory module(s)

SEQ ID NO: 7256 - protein, 1284 aa, Artificial Sequence
  Synthetic Polypeptide encoding a CAR with optional accessory module(s)
MALPVTALLLPLALLLHAARPGMRTEDLPKAVVFLEPQWYRVLEKDSVTLKCQGAYSPEDNSTQWFHNESLISSQASSYFIDAATVDDSGEYRCQTNLSTLSDPVQLEVHIGWLLLQAPRWVFKEEDPIHLRCHSWKNTALHKVTYLQNGKGRKYFHHNSDFYIPKATLKDSGSYFCRGLVGSKNVSSETVNITITQGLAVSTISSFFPPGYQLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMALPVTALLLPLALLLHAARPGMRTEDLPKAVVFLEPQWYRVLEKDSVTLKCQGAYSPEDNSTQWFHNESLISSQASSYFIDAATVDDSGEYRCQTNLSTLSDPVQLEVHIGWLLLQAPRWVFKEEDPIHLRCHSWKNTALHKVTYLQNGKGRKYFHHNSDFYIPKATLKDSGSYFCRGLVGSKNVSSETVNITITQGLAVSTISSFFPPGYQTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7257 - protein, 1207 aa, Artificial Sequence
  Synthetic Polypeptide encoding a CAR with optional accessory module(s)
MALPVTALLLPLALLLHAARPGMRTEDLPKAVVFLEPQWYRVLEKDSVTLKCQGAYSPEDNSTQWFHNESLISSQASSYFIDAATVDDSGEYRCQTNLSTLSDPVQLEVHIGWLLLQAPRWVFKEEDPIHLRCHSWKNTALHKVTYLQNGKGRKYFHHNSDFYIPKATLKDSGSYFCRGLVGSKNVSSETVNITITQGLAVSTISSFFPPGYQLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEVQLVESGGGLVQAGGSLRLSCAASGSIFSGNVMGWYRRQAPGKEREWVAAIASGGSIYYRDSVKGRFTISRDNAKNTVYLQMNSLKPEDTAVYYCNSHPPTLPYWGLGTQVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7258 - protein, 1130 aa, Artificial Sequence
  Synthetic Polypeptide encoding a CAR with optional accessory module(s)
MALPVTALLLPLALLLHAARPDEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7259 - protein, 1132 aa, Artificial Sequence
  Synthetic Polypeptide encoding a CAR with optional accessory module(s)
MALPVTALLLPLALLLHAARPDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7260 - protein, 1133 aa, Artificial Sequence
  Synthetic Polypeptide encoding a CAR with optional accessory module(s)
MALPVTALLLPLALLLHAARPDIQMTQSPSSLSASVGDRVTITCRSSQSIVHSVGNTFLEWYQQKPGKAPKLLIYKVSNRFSGVPSRFSGSGSGTDFTLTISSLQPEDFATYYCFQGSQFPYTFGQGTKVEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLVESGGGLVQPGGSLRLSCAASGYEFSRSWMNWVRQAPGKGLEWVGRIYPGDGDTNYSGKFKGRFTISADTSKNTAYLQMNSLRAEDTAVYYCARDGSSWDWYFDVWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7261 - protein, 1125 aa, Artificial Sequence
  Synthetic Polypeptide encoding a CAR with optional accessory module(s)
MALPVTALLLPLALLLHAARPDIVMTQSPSSLSASVGDRVTITCKASQSVTNDVAWYQQKPGKAPKLLIYYASNRYTGVPSRFSGSGSGTDFTLTISSLQPEDFATYYCQQDYRSPWTFGGGTKVEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLEESGGGVVRPGRSLRLSCAASGFTFSDYGVNWIRQAPGKGLEWVTIIWGDGRTDYNSALKSRFTVSRNNSNNTLSLQMNSLTTEDTAVYYCVRAPGNRAMEYWGQGVLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7262 - protein, 1131 aa, Artificial Sequence
  Synthetic Polypeptide encoding a CAR with optional accessory module(s)
MALPVTALLLPLALLLHAARPDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQIFGQGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7263 - protein, 1124 aa, Artificial Sequence
  Synthetic Polypeptide encoding a CAR with optional accessory module(s)
MALPVTALLLPLALLLHAARPDIQMTQSPATIENTSLSASVGDRVTITCRASQGISSWLTWYQQKPEKAPKSLIYAASSLQSGVPSRFSGSGSGTDFTLTISSLQPEDFATYYCQQYDSYPITFGQGTRLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLQQWGAGLLKPSETLSLTCAVYGGSFSAYYWSWIRQPPGKGLEWIGDINHGGGTNYNPSLKSRVTISVDTSKNQFSLKLNSVTAADTAVYYCASLTAYWGQGSLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7264 - protein, 1129 aa, Artificial Sequence
  Synthetic Polypeptide encoding a CAR with optional accessory module(s)
MALPVTALLLPLALLLHAARPDEIVLTQSPDSLAVSLGERATINCKASQSVDFDGDSYLNWYQQKPGQPPKVLIYAASTLQSGVPSRFSGSGSGTDFTLTINSLEAEDAATYYCQQSNEDPWTFGGGTKVEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLVQSGAEVKKPGASVKVSCKVSGYTFTDYYITWVRQAPGQALEWMGWIYPGSGNTKYSQKFQGRFVFSVDTSASTAYLQLSSLKAEDTAVYYCANYGNYWFAYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7265 - protein, 1126 aa, Artificial Sequence
  Synthetic Polypeptide encoding a CAR with optional accessory module(s)
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLVQSGGGLVHPGGSLRLSCAGSGFAFSSSTMHWIRQAPGKGLEWISLIGSGGGIYYGDSVKGRFTISRDNAKNSLYLQMNSLRAEDMAVYYCVRGYFDWVDYFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7266 - protein, 1136 aa, Artificial Sequence
  Synthetic Polypeptide encoding a CAR with optional accessory module(s)
MALPVTALLLPLALLLHAARPDDIVMTQSPDSLTVSLGERTTINCKSSQSVLDSSKNKNSLAWYQQKPGQPPKLLLSWASTRESGIPDRFSGSGSGTDFTLTIDSLQPEDSATYYCQQSAHFPITFGQGTRLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLVQSGAEVKKPGASVKVSCKASGYTFTNYGMNWVKQAPGQGLKWMGWINTYTGEPTYADDFKGRVTMTSDTSTSTAYLELHNLRSDDTAVYYCARWSWSDGYYVYFDYWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7267 - protein, 1132 aa, Artificial Sequence
  Synthetic Polypeptide encoding a CAR with optional accessory module(s)
MALPVTALLLPLALLLHAARPDEIVLTQSPGSLAVSPGERVTMSCKSSQSVFFSSSQKNYLAWYQQIPGQSPRLLIYWASTRESGVPDRFTGSGSGTDFTLTISSVQPEDLAIYYCHQYLSSRTFGQGTKLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLQQPGAEVVKPGASVKMSCKASGYTFTSYYIHWIKQTPGQGLEWVGVIYPGNDDISYNQKFQGKATLTADKSSTTAYMQLSSLTSEDSAVYYCAREVRLRYFDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7268 - protein, 1136 aa, Artificial Sequence
  Synthetic Polypeptide encoding a CAR with optional accessory module(s)
MALPVTALLLPLALLLHAARPDVLLTQSPLSLPVTLGQPASISCRSSQTIVHSNGNTYLEWFQQRPGQSPRLLIYQVSNRFSGVPDRFSGSGSGTDFTLKISRVEAEDVGVYYCFQGSHVPRTFGGGTKVEIKRALEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQIQLVQSGSELKKPGASVKVSCKASGYTFTNYGMNWVRQAPGQGLKWMGWINTNTGEPKYAEEFKGRFALSLDTSVSTAYLQINSLKAEDTAVYFCARGYGNYARGAWLAYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7269 - protein, 1121 aa, Artificial Sequence
  Synthetic Polypeptide encoding a CAR with optional accessory module(s)
MALPVTALLLPLALLLHAARPDEIVLTQSPATLSLSPGERATLSCSASSSINYIYWLQQKPGQAPRILIYLTSNLASGVPARFSGSGSGTDFTLTISSLEPEDFAVYYCLQWSSNPLTFGGGTKVEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLVESGGGLVKPGGSLRLSCAASGFTFSSYDMSWVRQAPGKGLEWVSTISSGGSYTYYLDSIKGRFTISRDNAKNSLYLQMNSLRAEDTAVYYCARQGLDYWGRGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7270 - protein, 1130 aa, Artificial Sequence
  Synthetic Polypeptide encoding a CAR with optional accessory module(s)
MALPVTALLLPLALLLHAARPDIVMTQSPDSLAVSLGERATINCRASKSVSTSGYSFMHWYQQKPGQPPKLLIYLASNLESGVPDRFSGSGSGTDFTLTISSLQAEDVAVYYCQHSREVPWTFGQGTKVEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLVQSGAEVKKPGASVKVSCKASGYTFTNYGMNWVRQAPGQGLEWMGWINTYTGEPTYADAFKGRFAFSLDTSTSTAYLQINSLRSDDTAVYYCARDYGDYGMDYWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7271 - protein, 1126 aa, Artificial Sequence
  Synthetic Polypeptide encoding a CAR with optional accessory module(s)
MALPVTALLLPLALLLHAARPDIVMTQTPLTLSVTIGQPASISCKSSQSLLDSDGKTYLNWLLQRPGQSPERLIYLVSKLDSGVPDRFTGSGSGTDFTLKISRVEAEDLGVYCCWQGTHFPYTFGGGTKVEIKGLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLQQPGAELVRPGASVKLSCKASGYTFTSYWMNWVKQRPGQGLEWIGMIDPSDSETHYNHIFKDKATLTVDKSSSTAYLQLSSLTSEDSAVYYCARNLYLWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7272 - protein, 1134 aa, Artificial Sequence
  Synthetic Polypeptide encoding a CAR with optional accessory module(s)
MALPVTALLLPLALLLHAARPDIVMTQSPDSLAVSLGERATINCESSQSLLNSGNQKNYLTWYQQKPGQPPKPLIYWASTRESGVPDRFSGSGSGTDFTLTISSLQAEDVAVYYCQNDYSYPYTFGQGTKLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLVQSGAEVKKPGESLKISCKGSGYSFTDYYMKWARQMPGKGLEWMGDIIPSNGATFYNQKFKGQVTISADKSISTTYLQWSSLKASDTAMYYCARSHLLRASWFAYWGQGTMVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7273 - protein, 1129 aa, Artificial Sequence
  Synthetic Polypeptide encoding a CAR with optional accessory module(s)
MALPVTALLLPLALLLHAARPDIQMTQSTSSLSASLGDRVTISCSASQGINNYLNWYQQKPDGTVELLIYYTSTLQSGVPSRFSGSGSGTDYSLTISNLEPEDIGTYYCQQYSKLPRTFGGGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLQQSGSELMMPGASVKISCKATGYTFSNYWIEWVKQRPGHGLEWIGEILPGTGRTIYNEKFKGKATFTADISSNTVQMQLSSLTSEDSAVYYCARRDYYGNFYYAMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7274 - protein, 1124 aa, Artificial Sequence
  Synthetic Polypeptide encoding a CAR with optional accessory module(s)
MALPVTALLLPLALLLHAARPDIQMTQSPASLSVSVGETVTITCRASENIYSNLAWYQQKQGKSPQLLVYAATNLADGVPSRFSGSGSGTQYSLKINSLQSEDFGSYYCQHFWGTWTFGGGTTLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLQQSGPELVKPGASVKMSCKASGYTFTDYYMKWMKQSHGKSLEWIGDINPNNGGTTYNQKFKGKATLTVDKSSSTAYMQLNSLTSEDSAVYYCARDYGYGYFDYWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7275 - protein, 1127 aa, Artificial Sequence
  Synthetic Polypeptide encoding a CAR with optional accessory module(s)
MALPVTALLLPLALLLHAARPEIVLTQSPGTLSLSPGERATLSCRASQSVGGYLAWYQQKPGQAPRLLIYDASNRATGIPARFSGSGSGTDFTLTISSLEPEDFAVYYCQQRNNWPPMYTFGQGTKLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLVQSGAEVKKPGSSVKVSCKASGGTFSSYAISWVRQAPGQGLEWMGGIIPILGTANYAQKFQGRVTITADESTSTAYMELSSLRSEDTAVYYCARWGGGAFDIWGQGTMVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7276 - protein, 1122 aa, Artificial Sequence
  Synthetic Polypeptide encoding a CAR with optional accessory module(s)
MALPVTALLLPLALLLHAARPQIVLTQSPALMSASPGEKVTMTCSASSSVRYMYWYQQKPRSSPKPWIHLTSNLASGVPARFSGSGSGTSYSLTISSMEAEDAATYYCQQWSSHPFTFGSGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEDVQLQESGPGLVKPSQSLSLTCTVTGFSITSDYSWNWIRQFPGNKLEWMGYISYSGHTSYNPSLESRISITRDTSKNQFFLQLNSVTTEDTATYYCTRGNWDVVYWGQGTLVTVSATRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7277 - protein, 1132 aa, Artificial Sequence
  Synthetic Polypeptide encoding a CAR with optional accessory module(s)
MALPVTALLLPLALLLHAARPDVVMTQSPLSLPVTLGQPASISCRSSQSIVHSDGNTYLEWYQQRPGQSPRRLIYKVSNRFSGVPDRFSGSGSGTDFTLKISRVEAEDVGVYYCFQGSHAPWTFGGGTKVEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLVESGGGLVQPGGSLRLSCAASGFTFSSYGMHWVRQAPGKGLEWVAYITTRSSTIYYADSVKGRFTISRDNAKNSLYLQMNSLRAEDTAVYYCTREPLTGYYAMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7278 - protein, 1124 aa, Artificial Sequence
  Synthetic Polypeptide encoding a CAR with optional accessory module(s)
MALPVTALLLPLALLLHAARPDIQMTQSPSSLSASVGDRVTITCRASQSISLWLNWYQQKPGKAPKLLIYAASTLQSGVPSRFSGSGSGTDFTLTISSLQPEDFATYYCQQYYTSPYTFGQGTKVEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLLESGGGLVQPGGSLRLSCAASGFTFSSYAMSWVRQAPGKGLEWVSVIRSSGSSTYYADSVKGRFTISRDNSKNTLYLQMNSLRAEDTAVYYCARGGGYFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7279 - protein, 1127 aa, Artificial Sequence
  Synthetic Polypeptide encoding a CAR with optional accessory module(s)
MALPVTALLLPLALLLHAARPDIQMTQSPSSLSASVGDRVTITCRASQSISSYLNWYQQKPGKAPKLLIYAVSTLQSGVPSRFSGSGSGTDFTLTISSLQPEDFATYYCQQSGTFPPTTFGQGTKVEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLLESGGGLVQPGGSLRLSCAASGFTFSSHGMHWVRQAPGKGLEWVSVISGSGSNTGYADSVKGRFTISRDNSKNTLYLQMNSLRAEDTAVYYCARQWGSYAFDSWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7280 - protein, 1137 aa, Artificial Sequence
  Synthetic Polypeptide encoding a CAR with optional accessory module(s)
MALPVTALLLPLALLLHAARPDIVMSQSPSSLAVSVGEKVTMSCKSSQSLLHSSNQKNYLAWYQQKPGQSPKVLIYWASTRESGVPDRFTGSGSGTDFTLTITSVKSEDLAVYYCQQYYSYPWTFGGGTRLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLQQSVAELVKPGASVKMSCKVSGYTLTDHTIHWMKQRPEQGLEWIGYIYPRDGITGYNEKFKGKATLTADTSSSTAYMQLNSLTSEDSAVYFCARWGYSYRNYAYYYDYWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7281 - protein, 1134 aa, Artificial Sequence
  Synthetic Polypeptide encoding a CAR with optional accessory module(s)
MALPVTALLLPLALLLHAARPEIVLTQSPGTLSLSPGERATLSCRASQSVSSSYLAWYQQKPGQAPRLLIYGTSSRATGIPDRFSGSGSGTDFTLTISRLEPEDFAVYYCQQYGSSPFTFGGGTKVEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLQESGPGLAKPSETLSLTCTVSGDSITSYYWSWIRQPPGKGLEWIGYIYYSGSTNYNPSLKSRVTISVDTSKNQFSLKLSSVTAADTAVYYCARDQRRIAAAGTHFYGMDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7282 - protein, 1126 aa, Artificial Sequence
  Synthetic Polypeptide encoding a CAR with optional accessory module(s)
MALPVTALLLPLALLLHAARPDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSATRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7283 - protein, 1119 aa, Artificial Sequence
  Synthetic Polypeptide encoding a CAR with optional accessory module(s)
MALPVTALLLPLALLLHAARPMTQSPKFLLVSAGDRVTLTCKASQSVNNDVYWYQQEPGQSPKLLIYWASTRESGVPDRFTGSGSGTDFTLTISSVQAEDLAVYYCKQSYNLYTFGGGTKLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEESGRGLVQPGGSRKLSCAASGFTFSTSGMHWVRQAPEKGLEWVAYISSGSTTIYHADTVKGRFTISRDNPKNTLFLQMTSLRSEDTAMYYCCARSGQFGNYFDYWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7284 - protein, 1124 aa, Artificial Sequence
  Synthetic Polypeptide encoding a CAR with optional accessory module(s)
MALPVTALLLPLALLLHAARPQSPSSLAVSAGEKVTMSCKSSQSLLNSRTRKNYLAWYQQKPGQSPKLLIYWASTRESGVPDRFTGSGSGTDFTLTISSVQAEDLAVYYCKQSNLYTFGGGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLEESGPELVKPGASVKLSCKASGYTFTEYIIHWVKQRSGQGLEWIGWFYPGSGSIKYNEKFKDKATLTADKSSSTVYMELSGLTSEDSAVYFCARHDGYSYFDYWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7285 - protein, 1136 aa, Artificial Sequence
  Synthetic Polypeptide encoding a CAR with optional accessory module(s)
MEMFQGLLLLLLLSMGGTWASREMLRPRCRPINATLAVEKEGCPVCITVNTTICAGYCPTMTRVLQGVLPALPQVVCNYRDVRFESIRLPGCPRGVNPVVSYAVALSCQCALCRRSTTDCGGPKDHPLTCDDPRFQASSSSKAPPPSLPSPSRLPGPSDTPILPQLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEAPDVQDCPECTLQENPFFSQPGAPILQCMGCCFSRAYPTPLRSKKTMLVQKNVTSESTCCVAKSYNRVTVMGGFKVENHTACHCSTCYYHKSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7286 - protein, 1127 aa, Artificial Sequence
  Synthetic Polypeptide encoding a CAR with optional accessory module(s)
MALPVTALLLPLALLLHAARPDIQMTQSPSSLSASLGERVSLTCRATQELSGYLSWLQQKPDGTIKRLIYAASTLDSGVPKRFSGNRSGSDYSLTISSLESEDFADYYCLQYAIYPYTFGGGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLQQSGPELVKPGASVKMSCKASGYTFTSYFIHWVKQKPGQGLEWIGFINPYNDGSKYNEKFKGKATLTSDKSSSTAYMELSSLTSEDSAVYYCTRDDGYYGYAMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7287 - protein, 1132 aa, Artificial Sequence
  Synthetic Polypeptide encoding a CAR with optional accessory module(s)
MALPVTALLLPLALLLHAARPDTIVLTQSPASLAVSLGQRATISCRASESVDSYGNSFMHWYQQKPGQPPKLLIYLASNLESGVPARFSGSGSRTDFTLTIDPVEADDAATYYCQQNNYDPWTFGGGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLQQSGPELVKPGASVKMSCKASGYTFTSYVMHWVKQKPGQGLEWIGYINPYNDGTKYNEKFKGKATLTSDTSSSTAYMELNSLTSEDSAVYFCARPIYFDNDYFDYWGQGTTLKVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7288 - protein, 1143 aa, Artificial Sequence
  Synthetic Polypeptide encoding a CAR with optional accessory module(s)
MALPVTALLLPLALLLHAARPDLNFMLTQPHSVSGSPGKTVTISCTRSTGSITSNYVHWYQQRPGSSPTTVICEDNERPSGVPDRFSGSIDISSNSASLTISGLKTEDEADYYCQSYDDSNHISVFGTGTKVTVLGQPKANPLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLQESGPGLVKPSETLSLTCTVSGGSISSSNYYWGWIRQPPGKGLEWIGAIYYSGSTYYNPSLKSRVAISVDTSKNQFSLKLSSVTAADTAVYYCARRIGVAGQWYFDLWGRGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7289 - protein, 1129 aa, Artificial Sequence
  Synthetic Polypeptide encoding a CAR with optional accessory module(s)
MALPVTALLLPLALLLHAARPDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQIQLVQSGPDLKKPGETVKISCKASGYTFTNTGMNWVKQAPGKGLKWMGWINTYTGEPTYADDFKGRFTFSLETSASTAYLQINNLKNEDTATYFCTRWGYGSSLYYAMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7290 - protein, 1127 aa, Artificial Sequence
  Synthetic Polypeptide encoding a CAR with optional accessory module(s)
MALPVTALLLPLALLLHAARPDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLVESGGGLVQPGGSLRLSCAASGFDFSRYWMSWVRQAPGKGLEWIGEINPDSSTINYAPSLKDKFIISRDNAKNSLYLQMNSLRAEDTAVYYCARPDGNYWYFDVWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7291 - protein, 1127 aa, Artificial Sequence
  Synthetic Polypeptide encoding a CAR with optional accessory module(s)
MALPVTALLLPLALLLHAARPDIVMTQSQKSMSTSVGDRVSITCKASQDVITGVAWYQQKPGQSPKLLIYSASYRYTGVPDRFTGSGSGTDFTFTISNVQAEDLAVYYCQQHYSTPLTFGAGTKLELKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLQQPGAELVRPGASVKLSCKASGYSFTTYWMNWVKQRPGQGLEWIGMIHPSDSETRLNQKFKDKATLTVDKSSSTAYMQLSSPTSEDSAVYYCARSTMIATRAMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7292 - protein, 1133 aa, Artificial Sequence
  Synthetic Polypeptide encoding a CAR with optional accessory module(s)
MALPVTALLLPLALLLHAARPQSVLTQPPSVSGAPGQRVTISCTGSGSNIGAPYDVSWYQQLPGTAPKLLIYHNNKRPSGVPDRFSGSKSGTSASLAITGLQAEDEADYYCATVEAGLSGSVFGGGTKLTVLGALEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSPLTLGLWGQGTMVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7293 - protein, 1133 aa, Artificial Sequence
  Synthetic Polypeptide encoding a CAR with optional accessory module(s)
MALPVTALLLPLALLLHAARPQSVLTQPPSVSGAPGQRVTISCTGSGSNIGAPYDVSWYQQLPGTAPKLLIYHNNKRPSGVPDRFSGSKSGTSASLAITGLQAEDEADYYCQSYDSSSISTIFGGGTKLTVLGALEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSGIAYRPWGQGTMVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7294 - protein, 1140 aa, Artificial Sequence
  Synthetic Polypeptide encoding a CAR with optional accessory module(s)
MDWIWRILFLVGAATGAHSFEVQLVESGGGSVQAGGSLRLSCTTSGRALNMYVMGWFRQAPGNEREFVAATSSSGGSTSYPDSVKGRFTISRDNAKNTVYLQMNSLKPEDTAAYRCAASPYVSTPTMNILEEYRYWGLGTQVTVSSLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEVQLVESGGGLVQAGGSLRLSCAASGSIFSGNVMGWYRRQAPGKEREWVAAIASGGSIYYRDSVKGRFTISRDNAKNTVYLQMNSLKPEDTAVYYCNSHPPTLPYWGLGTQVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7295 - protein, 1217 aa, Artificial Sequence
  Synthetic Polypeptide encoding a CAR with optional accessory module(s)
MDWIWRILFLVGAATGAHSFEVQLVESGGGSVQAGGSLRLSCTTSGRALNMYVMGWFRQAPGNEREFVAATSSSGGSTSYPDSVKGRFTISRDNAKNTVYLQMNSLKPEDTAAYRCAASPYVSTPTMNILEEYRYWGLGTQVTVSSLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMALPVTALLLPLALLLHAARPGMRTEDLPKAVVFLEPQWYRVLEKDSVTLKCQGAYSPEDNSTQWFHNESLISSQASSYFIDAATVDDSGEYRCQTNLSTLSDPVQLEVHIGWLLLQAPRWVFKEEDPIHLRCHSWKNTALHKVTYLQNGKGRKYFHHNSDFYIPKATLKDSGSYFCRGLVGSKNVSSETVNITITQGLAVSTISSFFPPGYQTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7296 - protein, 1217 aa, Artificial Sequence; identical to SEQ ID NO: 7295
  Synthetic Polypeptide encoding a CAR with optional accessory module(s)

SEQ ID NO: 7297 - protein, 1267 aa, Artificial Sequence
  Synthetic Polypeptide encoding a CAR with optional accessory module(s)
MDWIWRILFLVGAATGAHSFEVQLVESGGGSVQAGGSLRLSCTTSGRALNMYVMGWFRQAPGNEREFVAATSSSGGSTSYPDSVKGRFTISRDNAKNTVYLQMNSLKPEDTAAYRCAASPYVSTPTMNILEEYRYWGLGTQVTVSSLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSATMALPVTALLLPLALLLHAARPDVQLQESGPGLVKPSQSLSLTCTVTGYSITSDYTWNWIRQFPGNKLEWMGYITYSGSTSYNPSLKSRNSITRDTSKNQFFLQLNSVTTEDTATYYCARLGRRYTMDYWGQGTSVTVSSGGGGSGGGGSGGGGSDIQMTQSSSSFSVSLGDRVTITCMASEDIYIRLAWYQQKPGNAPRLLISAATSLETGVPSRFSGSGSGKDYTLSITSLQTEDVGTYYCQQYWSSPWTFGGGTKLEINTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7298 - protein, 1140 aa, Artificial Sequence
  Synthetic Polypeptide encoding a CAR with optional accessory module(s)
MALPVTALLLPLALLLHAARPDEFEVQLVESGGGLVQAGGSLRLSCVASGISSSKRNMGWYRQAPGKQRESVATISSGGNKDYTDAVKDRFTISRDTTKNTVYLQMNSLKPEDTAVYYCKIEAGTGWATRRGYTYWGQGTLVTVSSLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEVQLVESGGGLVQAGGSLRLSCAASGSIFSGNVMGWYRRQAPGKEREWVAAIASGGSIYYRDSVKGRFTISRDNAKNTVYLQMNSLKPEDTAVYYCNSHPPTLPYWGLGTQVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7299 - protein, 1154 aa, Artificial Sequence
  Synthetic Polypeptide encoding a CAR with optional accessory module(s)
MALPVTALLLPLALLLHAARPDEFEVQLVESGGGLVQAGDSLRLSCAASGRAFSRYAMGWFRQAPGKEREFVAAIGWGPSKTNYADSVKGRFTISRDNAKNTVYLQMNTLKPEDTAVYSCAAKFVNTDSTWSRSEMYTYWGQGTLVTVSSLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEVQLVESGGGSVQAGGSLRLSCTTSGRALNMYVMGWFRQAPGNEREFVAATSSSGGSTSYPDSVKGRFTISRDNAKNTVYLQMNSLKPEDTAAYRCAASPYVSTPTMNILEEYRYWGLGTQVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7300 - protein, 1131 aa, Artificial Sequence
  Synthetic Polypeptide encoding a CAR with optional accessory module(s)
MALPVTALLLPLALLLHAARPDIQMTQSPSSLSASVGDRVTITCSASSSVSYMYWYQQKPGKAPKLLIYLTSNLASGVPSRFSGSGSGTDFTLTISSLQPEDFATYYCQQWRSNPFTFGQGTKLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQITLKESGPTLVKPTQTLTLTCTFSGFSLSTSGMGVGWIRQPPGKALEWLAHIWWDDVKRYSPSLKSRLTITKDTSKNQVVLTMTNMDPVDTATYYCARIVSFDNDVVSAMDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7301 - protein, 1126 aa, Artificial Sequence
  Synthetic Polypeptide encoding a CAR with optional accessory module(s)
MALPVTALLLPLALLLHAARPEIVMTQSPATLSVSPGERATLSCKASQSVSNDVVWYQQKPGQAPRLLIYYASNRYTGIPARFSGSGSGTEFTLTISSLQSEDFAVYYCQQDYTSPWTFGQGTKLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLVQSGAEVKKPGASVKVSCKASGYTFTNYGMNWVRQAPGQGLEWMGWINTYTGEPTYADDFKGRVTMTTDTSTSTAYMELRSLRSDDTAVYYCARIGDSSPSDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7302 - protein, 1127 aa, Artificial Sequence
  Synthetic Polypeptide encoding a CAR with optional accessory module(s)
MALPVTALLLPLALLLHAARPDSTDIQMTQSPSSLSASVGDRVTITCRASQSISSYLNWYQQKPGKAPKLLIYLASNLQSGVPSRFSGSGSGTDFTLTISSLQPEDFATYYCQQAEYMPLTFGQGTKVEIKRALEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLLESGGGLVQPGGSLRLSCAASGFTFSGYAMSWVRQAPGKGLEWVSEIAPPGLNTRYADSVKGRFTISRDNSKNTLYLQMNSLRAEDTAVYYCAKSDTAFDYWGQGTLVTVSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7303 - protein, 1130 aa, Artificial Sequence
  Synthetic Polypeptide encoding a CAR with optional accessory module(s)
MALPVTALLLPLALLLHAARPDQAVLTQESALTTSPGETVTLTCRSSTGAVTTSNYANWVQEKPDHLFTGLIGGTNNRVPGVPARFSGSLIGDKAALTITGAQTEDEAIYFCVLWHSNHWVFGGGTKLTVLLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEDVQLVESGGGLVQPGGSRKLSCAASGFTFSSFGMHWVRQAPEKGLEWVAYISSGSSTLHYADTVKGRFTISRDNPKNTLFLQMTSLRSEDTAMYYCARWGNYPHYAMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7304 - protein, 1152 aa, Artificial Sequence
  Synthetic Polypeptide encoding a CAR with optional accessory module(s)
MALPVTALLLPLALLLHAARPDEFEVQLVESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTLVTVSSLELEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLVESGGGSVQAGGSLRLSCAASGDTYGSYWMGWFRQAPGKEREGVAAINRGGGYTVYADSVKGRFTISRDTAKNTVYLQMNSLRPDDTADYYCAASGVLGGLHEDWFNYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7305 - protein, 1149 aa, Artificial Sequence
  Synthetic Polypeptide encoding a CAR with optional accessory module(s)
MALPVTALLLPLALLLHAARPDEFEVQLVESGGGSVQAGGSLRLTCAASGSTSRSYGMGWFRQAPGKEREFVSGISWRGDSTGYADSVKGRFTISRDNAKNTVDLQMNSLKPEDTAIYYCAAAAGSTWYGTLYEYDYWGQGTLVTVSSLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEVQLVESGGGSVQAGGSLRLSCAASGDTYGSYWMGWFRQAPGQEREAVAAINRGGGYTVYADSVKGRFTISRDNAKNTLYLQMNSLRPDDTADYYCAASGVLGGLHEDWFNYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7306 - protein, 1121 aa, Artificial Sequence
  Synthetic Polypeptide encoding a CAR with optional accessory module(s)
MALPVTALLLPLALLLHAARPDIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVELEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7307 - protein, 1127 aa, Artificial Sequence
  Synthetic Polypeptide encoding a CAR with optional accessory module(s)
MALPVTALLLPLALLLHAARPDEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7308 - protein, 1134 aa, Artificial Sequence
  Synthetic Polypeptide encoding a CAR with optional accessory module(s)
MALPVTALLLPLALLLHAARPDELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7309 - protein, 1135 aa, Artificial Sequence
  Synthetic Polypeptide encoding a CAR with optional accessory module(s)
MALPVTALLLPLALLLHAARPDELQMTQSPSSLSASVGDRVTITCRASQSISSYLNWYQQKPGQPPKLLIYWASTRESGVPDRFSGSESGTNYTLTISSLQPEDFATYFCQQSDSLPITFGQGTRLDIQLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLLESGGGVVQPGRSLRLSCAASGFTFSSYGMHWVRQAPGKGLEWVAVISYDGSNKYYADSVKGRFTISRDNSKNTLYLQMNSLRAEDTAVYYCAKDMGWGSGWRPYYYYGMDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7310 - protein, 1132 aa, Artificial Sequence
  Synthetic Polypeptide encoding a CAR with optional accessory module(s)
MALPVTALLLPLALLLHAARPDDIQMTQSPSSLSASVGDRVTITCRASQSISSYLNWYQQKPGKAPKLLIYAASSLQSGVPSRFSGSGSGTDFTLTISSLQPEDLATYYCQQSYSTPFTFGPGTKVDIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEVHEVQLVQSGAEVKKPGSSVKVSCKASGGTFSSYAISWVRQAPGQGLEWMGGIIPIFGTANYAQKFQGRVTITADKSTSTAYMELSSLRSEDTAVYYCATFALFGFREQAFDIWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7311 - protein, 1129 aa, Artificial Sequence
  Synthetic Polypeptide encoding a CAR with optional accessory module(s)
MALPVTALLLPLALLLHAARPDVVMTQTPLSLPVSLGDQASISCRSSQSLVHSNGNTYLRWYLQKPGQSPKVLIYKVSNRFSGVPDRFSGSGSGTDFTLKISRVEAEDLGVYFCSQSTHVPWTFGGGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVKLDETGGGLVQPGRPMKLSCVASGFTFSDYWMNWVRQSPEKGLEWVAQIRNKPYNYETYYSDSVKGRFTISRDDSKSSVYLQMNNLRVEDMGIYYCTGSYYGMDYWGQGTSVTVSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7312 - protein, 1131 aa, Artificial Sequence
  Synthetic Polypeptide encoding a CAR with optional accessory module(s)
MALPVTALLLPLALLLHAARPDIQMTQSPSSLSASVGDRVTITCRTSQSLSSYTHWYQQKPGKAPKLLIYAASSRGSGVPSRFSGSGSGTDFTLTISSLQPEDFATYYCQQSRTFGQGTKVEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLQQSGPGLVKPSQTLSLTCAISGDSVSSYNAVWNWIRQSPSRGLEWLGRTYYRSGWYNDYAESVKSRITINPDTSKNQFSLQLNSVTPEDTAVYYCARSGHITVFGVNVDAFDMWGQGTMVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7313 - protein, 1130 aa, Artificial Sequence
  Synthetic Polypeptide encoding a CAR with optional accessory module(s)
MALPVTALLLPLALLLHAARPDIVLTQSPLSLAVSLGQPAIISCKASQSVSFAGTSLMHWYHQKPGQQPRLLIYRASNLEAGVPDRFSGSGSKTDFTLTISPVEAEDAATYYCQQSREYPYTFGGGTKLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLVQSGAEVVKPGASVKISCKASGYTFTGYFMNWVKQSPGQSLEWIGRIHPYDGDTFYNQKFQGKATLTVDKSSNTAHMELLSLTSEDFAVYYCTRYDGSRAMDYWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7314 - protein, 1103 aa, Artificial Sequence
  Synthetic Polypeptide encoding a CAR with optional accessory module(s)
MALPVTALLLPLALLLHAARPNSCELTNITIAIEKEECRFCISINTTWCAGYCYTRDLVYKDPARPKIQKTCTFKELVYETVRVPGCAHHADSLYTYPVATQCHCGKCDSDSTDCTVRGLGPSYCSFGEMKELEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEAPDVQDCPECTLQENPFFSQPGAPILQCMGCCFSRAYPTPLRSKKTMLVQKNVTSESTCCVAKSYNRVTVMGGFKVENHTACHCSTCYYHKSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7315 - protein, 1127 aa, Artificial Sequence
  Synthetic Polypeptide encoding a CAR with optional accessory module(s)
MALPVTALLLPLALLLHAARPDDVVMTQTPLSLPVTPGEPASISCRSSQSLVHRNGNTYLHWYLQKPGQSPKLLIHKVSNRFSGVPDRFSGSGSGTDFTLKISRVEAEDLGVYFCSQSTHVPPLTFGAGTKLELKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLVQSGAEVEKPGASVKISCKASGSSFTGYNMNWVRQNIGKSLEWIGAIDPYYGGTSYNQKFKGRATLTVDKSTSTAYMHLKSLRSEDTAVYYCVSGMEYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7316 - protein, 1125 aa, Artificial Sequence
  Synthetic Polypeptide encoding a CAR with optional accessory module(s)
MALPVTALLLPLALLLHAARPDEIVMTQTPATLSVSAGERVTITCKASQSVSNDVTWYQQKPGQAPRLLIYSASNRYSGVPARFSGSGYGTEFTFTISSVQSEDFAVYFCQQDYSSFGQGTKLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLVESGPGVVQPGRSLRISCAVSGFSVTNYGVHWVRQPPGKGLEWLGVIWAGGITNYNSAFMSRLTISKDNSKNTVYLQMNSLRAEDTAMYYCASRGGHYGYALDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7317 - protein, 1127 aa, Artificial Sequence
  Synthetic Polypeptide encoding a CAR with optional accessory module(s)
MALPVTALLLPLALLLHAARPDIQMTQTASSLPASLGDRVTISCSASQDISNYLNWYQQKPDGTVKLLIFYSSNLHSGVPSRFSGGGSGTDYSLTISNLEPEDIATYFCHQYSKLPWTFGGGTKLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVTLVESGGDFVKPGGSLKVSCAASGFAFSHYAMSWVRQTPAKRLEWVAYISSGGSGTYYSDSVKGRFTISRDNAKNTLYLQMRSLRSEDSAMYFCTRVKLGTYYFDSWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7318 - protein, 1129 aa, Artificial Sequence
  Synthetic Polypeptide encoding a CAR with optional accessory module(s)
MALPVTALLLPLALLLHAARPQFVLTQSPSASAALGASAKLTCTLSSAHKTYTIDWYQQQKGKAPRYLIQVKSDGTYTKATGVPDRFSGSSSGADRYLIIPSVQADDEADYYCGTDYTGGYVFGGGTQLTVTLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEQLKESGGGLFKPTDTLTLTCTVSGFSLSYYGVNWVRQAPGNGLEWIGTIGGSGDTYYASWAKSRSTIIRNTNENTVTLKMTSLTAADTATYFCVRYANIGYEYFNVWGPGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7319 - protein, 1134 aa, Artificial Sequence
  Synthetic Polypeptide encoding a CAR with optional accessory module(s)
MALPVTALLLPLALLLHAARPQFVLTQSPSVSAALGASAKLTCTLSSAHKTYTIDWYQQQQGEAPRYLMQVKSDGSYTKGTGVPDRFSGSSSGADRYLIIPSVQADDEAGYVCGADDNGGYVFGGGTQLTVTLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQSVKESEGGLFKPTDTLTLTCTVSGFSLSRHALTWVRQAPGNGLEWIGAIDNAGTTYYASWAKSRSTITRNTDLHTVTLKMTSLTASDTATYFCARVFYDINSGYYLDGMDLWGPGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7320 - protein, 1128 aa, Artificial Sequence
  Synthetic Polypeptide encoding a CAR with optional accessory module(s)
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLVESGGGLVQPGESLRLSCVASGFTFSRYKMNWVRQAPGKGLEWVSYISRSGRDIYYADSVKGRFTISRDNAKNSLYLQMNSLRDEDTAVYYCAGTVTTYYYFGMDVWGHGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7321 - protein, 1129 aa, Artificial Sequence
  Synthetic Polypeptide encoding a CAR with optional accessory module(s)
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLVESGGGSVQPGESLRLSCVASGFTFSRYKMNWVRQAPGKGLEWVSYISRSGRDIYYADSVKGRFTISRDNAKNSLYLQMNSLRDEDTAVYYCAGTVTTYYYDFGMDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7322 - protein, 1127 aa, Artificial Sequence
  Synthetic Polypeptide encoding a CAR with optional accessory module(s)
MALPVTALLLPLALLLHAARPQSVLTQPPSASGTPGQRVTISCSGSRSNVGGNYVFWYQQVPGATPKLLIYRSNQRPSGVPDRFAGSKSGSSASLAISGLRSEDEADYYCATWDDSLSGFVFGTGTKVTVLGLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARGYGKAYDQWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7323 - protein, 1126 aa, Artificial Sequence
  Synthetic Polypeptide encoding a CAR with optional accessory module(s)
MALPVTALLLPLALLLHAARPQSVVTQPPSMSAAPGQQVTISCSGGNSNIERNYVSWYLQLPGTAPKLVIFDNDRRPSGIPDRFSGSKSGTSATLGITGLQTGDEADYYCGTWDSSLRGWVFGGGTKLTVLGLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEVQLVESGGGLIQPGGSLRLSCAASGFTFSNYAMNWVRQAPGKGLEWVSTINGRGSSTIYADSVKGRFTISRDNSKNTLYLQMNSLRAEDTATYYCARYISRGLGDSWGQGTLVTVTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7324 - protein, 1127 aa, Artificial Sequence
  Synthetic Polypeptide encoding a CAR with optional accessory module(s)
MALPVTALLLPLALLLHAARPDNIELTQSPAIMSASPGERVTMTCSASSSIRYIYWYQQKPGSSPRLLIYDTSNVAPGVPFRFSGSGSGTSYSLTINRMEAEDAATYYCQEWSGYPYTFGGGTKLDIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVKLQESGGGLVKPGGSLKLSCAASGFTFSSYGMSWVRQTPDKRLEWVATISSGGSYTYYPDSVKGRFTISRDNAKNTLYLQMSSLKSEDTAMYYCARGNWEGWYFDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7325 - protein, 1137 aa, Artificial Sequence
  Synthetic Polypeptide encoding a CAR with optional accessory module(s)
MALPVTALLLPLALLLHAARPDNFMLTQPHSVSESPGKTVTISCTGSGGSIDNNYVHWYQQRPGSAPTTVMFEDNQRPSGVPDRFSGSIDSSSNSASLVISGLKTEDEGDYYCQSSDGSKVVFGGGTKLTVLGQLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLVQSGGGSLTLSCAASGVVQPGRFTFSSYGMHWVRQAPGKGLEWVSVISYDGSNKYYADSVKGRFTISRDNSKNTLYLQMNSLRTEDTAVYYCAKTLSAGEWIGGGAFDIWGHGTMVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7326 - protein, 1127 aa, Artificial Sequence
  Synthetic Polypeptide encoding a CAR with optional accessory module(s)
MALPVTALLLPLALLLHAARPDVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQNTPVPPKFGSGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLQQSGAELVRPGASVKLSCKASGYTFNDYEMHWVKQTPVHGLKWIGALEPKTGDTAYSQKFKGKATLTADKSSSTAYMELRSLTSEDSAVYYCTSCYYYTYSGQGTLVTVSATRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7327 - protein, 1126 aa, Artificial Sequence
  Synthetic Polypeptide encoding a CAR with optional accessory module(s)
MALPVTALLLPLALLLHAARPDIQLTQSPSSLSASVGDRVTITCRASQGIRNDLGWYQQKPGKAPKRLIYAASSLQNGVPSRFSGSGSGTEFTLTISSLQPEDFATYYCLQHNTYPAFGQGTKVEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLQESGPGLVKPSQTLSLTCTVSGGSISSFNYYWSWIRHHPGKGLEWIGYIYYSGSTYSNPSLKSRVTISVDTSKNQFSLTLSSVTAADTAVYYCARGYNWNYFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7328 - protein, 1128 aa, Artificial Sequence
  Synthetic Polypeptide encoding a CAR with optional accessory module(s)
MALPVTALLLPLALLLHAARPDDIVLTQSPASLAVSLGQSVTISCRASESVEYYGTSLMQWYQQKPGQPPKLLIYATSNVESGVPARFSGSGSGTDFSLNIHPVEEDDIAMYFCQQSRKLPSTFGGGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEDVRLQESGPGQVKPSQTVSLTCSVTGYSITNGNHWWNWIRQVSGSKLEWIGYISSSGSTDSNPSLKSRISITRDTSKNQLFLQLNSVTTEDIATYYCARGYYFDYWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7329 - protein, 1153 aa, Artificial Sequence
  Synthetic Polypeptide encoding a CAR with optional accessory module(s)
MALPVTALLLPLALLLHAARPDEFGSDLGIKLLFAAAKGQDDEVRILLAAGADVNAKDFEGYTPLHVAAYDGHLEIVEVLLKAGADVNAKDSQGRTPLHEAAYSGHLEIVEVLLKAGADVNAQDDAGETPADLAAAWGHEDIAEVLQKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFERSDLGKKLLEAARAGQDDEVRILMANGADVNAKDEYGLTPLYLATAHGHLEIVEVLLKNGADVNAVDAIGFTPLHLAAFIGHLEIAEVLLKHGADVNAQDKFGKTAFDISIGNGNEDLAEILQKLNTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7330 - protein, 1139 aa, Artificial Sequence
  Synthetic Polypeptide encoding a CAR with optional accessory module(s)
MALPVTALLLPLALLLHAARPDEFEVQLVESGGGLVQAGGSLRLSCAASGITFSINTMGWYRQAPGKQRELVALISSIGDTYYADSVKGRFTISRDNAKNTVYLQMNSLKPEDTAVYYCKRFRTAAQGTDYWGQGTQVTVSSLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEVQLVESGGGLVQPGGSLRLSCAASGSIFGFNDMAWYRQAPGKQRELVALISRVGVTSSADSVKGRFTISRVNAKDTVYLQMNSLKPEDTAVYYCYMDQRLDGSTLAYWGQGTQVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7331 - protein, 1127 aa, Artificial Sequence
  Synthetic Polypeptide encoding a CAR with optional accessory module(s)
MALPVTALLLPLALLLHAARPDIQMTQSPSSLSASVGDRVTITCRASQDVNTAVAWYQQKPGKAPKLLIYSASFLESGVPSRFSGSRSGTDFTLTISSLQPEDFATYYCQQHYTTPPTFGQTKVEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDVWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7332 - protein, 1144 aa, Artificial Sequence
  Synthetic Polypeptide encoding a CAR with optional accessory module(s)
MALPVTALLLPLALLLHAARPDEFDVQLVESGGGLVQPGGSLRLSCAASGSIGGLNAMAWYRQAPGKERELVAGIFGVGSTRYADSVKGRFTISRDNSKNTVYLQMNSLRPEDTAVYYCRMSSVTRGSSDYWGQGTLVTVSSLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEVQLVESGGSLVQPGGSLRLSCAASGFTFDDYAMSWVRQVPGKGLEWVSSINWSGTHTDYADSVKGRFTISRNNANNTLYLQMNSLKSEDTAVYYCAKNWRDAGTTWFEKSGSAGQGTQVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7333 - protein, 1126 aa, Artificial Sequence
  Synthetic Polypeptide encoding a CAR with optional accessory module(s)
MALPVTALLLPLALLLHAARPDQSVLTQPPSVSVAPGKTARIPCEGNYIGSSNVHWYQQKPGQAPVLVIHFDSDRPSGIPDRFSGSNSGNMATLTISRVEAGDEADYYCQVWENHGWVFGGGTKLTVLSLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLVETGGGLVQPGESLRLSCAASGFTFSDYEMNWVRQAPGKGLEWVSYISSSGSTIYYADSVKGRFTIYRDNAKNSLYLQMNSLRAEDTALYYCARAWGVGPPDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7334 - protein, 1134 aa, Artificial Sequence
  Synthetic Polypeptide encoding a CAR with optional accessory module(s)
MALPVTALLLPLALLLHAARPDIQMTQSPSSLSASVGDTVTITCQANGYLNWYQQRRGKAPKLLIYDGSKLERGVPSRFSGRRWGQEYNLTINNLQPEDIATYFCQVYEFVVPGTRLDLKRTVAAPLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVSSASTKGPTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7335 - protein, 1140 aa, Artificial Sequence
  Synthetic Polypeptide encoding a CAR with optional accessory module(s)
MALPVTALLLPLALLLHAARPQSALTQPPSASGSPGQSITISCTGTSNNFVSWYQQHAGKAPKLVIYDVNKRPSGVPDRFSGSKSGNTASLTVSGLQTDDEAVYYCGSLVGNWDVIFGGGTKLTVLLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQPQLQESGPTLVEASETLSLTCAVSGDSTAACNSFWGWVRQPPGKGLEWVGSLSHCASYWNRGWTYHNPSLKSRLTLALDTPKNLVFLKLNSVTAADTATYYCARFGGEVLRYTDWPKPAWVDLWGRGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7336 - protein, 1125 aa, Artificial Sequence
  Synthetic Polypeptide encoding a CAR with optional accessory module(s)
MALPVTALLLPLALLLHAARPEIVLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLVQSGGQMKKPGESMRISCRASGYEFIDCTLNWIRLAPGKRPEWMGWLKPRGGAVNYARPLQGRVTMTRDVYSDTAFLELRSLTVDDTAVYFCTRGKNCDYNWDFEHWGRGTPVIVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7337 - protein, 1135 aa, Artificial Sequence
  Synthetic Polypeptide encoding a CAR with optional accessory module(s)
MALPVTALLLPLALLLHAARPELVLTQSPGTLSLSAGERATLSCRASQSVSSGSLAWYQQKPGQAPRLLIYGASTRATGIPDRFSGSGSGTDFTLTIGRLEPEDLAVYYCQQYGTSPYTFGQGTKLEILEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFELEQSGAEVKKPGSSVQVSCKASGGTFSMYGFNWVRQAPGHGLEWMGGIIPIFGTSNYAQKFRGRVTFTADQATSTAYMELTNLRSDDTAVYYCARDFGPDWEDGDSYDGSGRGFFDFWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7338 - protein, 1131 aa, Artificial Sequence
  Synthetic Polypeptide encoding a CAR with optional accessory module(s)
MALPVTALLLPLALLLHAARPDDIVMTQSQDSMATSVGERVTVNCKASQNVDTNVAWYQQKPGQSPEPLLFSASYRYTGVPDRFSGSGSGTDFTLTISSVQAEDVAEYFCQQYNSYPLTFGQGTKLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQVEVSGGGLVQPGGSMRLSCAVSGFTFSNYWMNWVRQSPEKGLEWIAEIRLKSNNFARYYAESVKGRFTISRDNSKNSLYLQMISLRAEDTAIYYCTSYGNYVGHYFDHWGQGTLLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7339 - protein, 1138 aa, Artificial Sequence
  Synthetic Polypeptide encoding a CAR with optional accessory module(s)
MALPVTALLLPLALLLHAARPDEIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPRTFGQGTKVEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLVQSGGGVVQPGRSLRLSCAASGFTFSSYGMHWVRQAPGKGLEWVAVISYDGSNKYYADSVKGRFTISRDNSKNTLYLQMNSLRAEDTAVYYCARDFDYGDSYYYYGMDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7340 - protein, 1132 aa, Artificial Sequence
  Synthetic Polypeptide encoding a CAR with optional accessory module(s)
MALPVTALLLPLALLLHAARPDEIVLTQSPATLSLSPGERATLSCRASQSVGSYLAWYQQKPGAPRLLIYDASHRATGIPARFSGSGSGTDFTLTISSLEPEDFAVYYCQQRSNWPPMYTFGQGTKLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLVQSGAEVSVKVSCKASGGKKPGSTFSSYTISWVRQAPGQGLEWMGGIIPIFGTANYAQKFQGRVTITADKSTSTAYMELSSLRSEDTAVYYCAGDTDSSGYYGAVDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7341 - protein, 1115 aa, Artificial Sequence
  Synthetic Polypeptide encoding a CAR with optional accessory module(s)
MALPVTALLLPLALLLHAARPDIQMTQSPSSLSASVGDRVTITCQASQDINNYLNWYQQKPGKAPKLLIYDASNLQTGVPSRFSGSGSGTDFTFTIEDIATYYCQQYTFGPGTKVDIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLLESGGGLVQPGGSLRLSCAASGFTFSWYSMTWVRQAPGKGLEWVSSIVPWGDFTQYADSVKGRFTISRDNSKNTLYLQMNSLRAEDTAVYYCAKGPGWGSFDLWGRGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7342 - protein, 1261 aa, Artificial Sequence
  Synthetic Polypeptide encoding a CAR with optional accessory module(s)
MDWIWRILFLVGAATGAHSEVQLVESGGGLVQPGGSLRLSCAASGSVFKINVMAWYRQAPGKGRELVAGIISGGSTSYADSVKGRFTISRDNAKNTLYLQMNSLRPEDTAVYYCAFITTESDYDLGRRYWGQGTLVTVSSLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7343 - protein, 1125 aa, Artificial Sequence
  Synthetic Polypeptide encoding a CAR with optional accessory module(s)
MALPVTALLLPLALLLHAARPDIQMTQSPSSLSASVGDRVTITCTASLSVSSTYLHWYQQKPGSSPKLWIYSTSNLASGVPSRFSGSGSGTSYTLTISSLQPEDFATYYCHQYHRSPLTFGGGTKVEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLVESGGGLVQPGGSLRLSCAASGFSLTKYGVHWVRQAPGKGLEWVGVKWAGGSTDYNSALMSRFTISKDNAKNSLYLQMNSLRAEDTAVYYCARDHRDAMDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7344 - protein, 1129 aa, Artificial Sequence
  Synthetic Polypeptide encoding a CAR with optional accessory module(s)
MALPVTALLLPLALLLHAARPDIQMTQSPSSLSASVGDRVTITCKASQDVGTAVAWYQQKPGKAPKLLIYSASYRSTGVPSRFSGSGSGTDFTLTISSLQPEDFATYYCQHHYSAPWTFGGGTKVEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLVESGGGLVQPGGSLRLSCAASGFTFSRNGMSWVRQAPGKGLEWVATVSSGGSYIYYADSVKGRFTISRDNAKNSLYLQMNSLRAEDTAVYYCARQGTTALATRFFDVWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7345 - protein, 1135 aa, Artificial Sequence
  Synthetic Polypeptide encoding a CAR with optional accessory module(s)
MALPVTALLLPLALLLHAARPDIVMTQSPSSLTMSVGQKVTMSCKSSHSLLNSRNQKNYLAWFQQKPGQSPKLLVYFASTRESGVPDRFIGSGSGTDFTLTISNVQAEDLADYFCQQHYTTLPTFGGGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQIQLVQSGPDLKKPGETVKISCKASGYTFTNTGMNWVKQAPGKGLKWMGWINTYTGEPTYADDFKGRFTFSLETSASTAYLQINNLKNEDTATYFCTRWGYGSSLYYAMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7346 - protein, 1125 aa, Artificial Sequence
  Synthetic Polypeptide encoding a CAR with optional accessory module(s)
MALPVTALLLPLALLLHAARPDIQMTQSPPSLSASVGGKVTITCKASQDIDRYMAWYQDKPGKGPKLLIHDTSTLQPGIPSRFSGSGSGRDYSFSISNLEPEDIATYYCLQYDNLWTFGGGTKLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLVQSGAELVKPGASVKMSCKASGYIFTNYNIHWVKKSPGQGLEWIGAIYPGNGDAPYSQKFQDRATLTADTSSSTTYMELSSLTSEDSAVYYCVRANWDVAFAYWGQGTLVSVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7347 - protein, 1126 aa, Artificial Sequence
  Synthetic Polypeptide encoding a CAR with optional accessory module(s)
MALPVTALLLPLALLLHAARPDIQMTQSPASLSASVGETVTITCRVSGNIHNYLAWYQQKQGKSPQLLVYNAKTLADGVPSRFSGSGSGTQYSLKINSLQPEDFGSYYCQHFWSNPYTFGGGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLQQSGASVKVSCKASELVRPGTGYAFTNYLIEWVKQRPGQGLEWIGVINPGSGGTNYNEKFKGKATLTADKSSSTAYMQLSSLTSDDSAVYFCARYRSYDWYFDVWGAGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7348 - protein, 1131 aa, Artificial Sequence
  Synthetic Polypeptide encoding a CAR with optional accessory module(s)
MALPVTALLLPLALLLHAARPDDIQMTQSPSSLSASVGDRVTITCRSSQRIVHSNGNTYLEWYQQTPGKAPKLLIYKVSNRFSGVPSRFSGSGSGTDYTPTISSLQPEDIATYYCFQGSHVPPTFGQGTKLQITLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLVESGGGVVQPGRSLRLSCSSSGPTFSDYYMYWVRQAPGKGLEWVAYMSNVGAITDYPDTVKGRPTISRDNSKNTLFLMDSLRPEDTGVYFCARGTRDGSWFAYWGQGTPVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7349 - protein, 1125 aa, Artificial Sequence
  Synthetic Polypeptide encoding a CAR with optional accessory module(s)
MALPVTALLLPLALLLHAARPDIQMTQSFSSLSASVGDRVTITCRASQDISNYLNWYQQKPGKAPKLLIYYTSRLHSGVPSRFSGSGSGTDYTLTISSLQPEDFATYFCQQGNTLPWTFGGGTKLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLVQSGGGLVQSGGSLRLSCRASGYTFTRYWMLWVRQRPGKGLEWVAEINPRNDRTNYNEKFKTRFTISVDRSKNTLYLQMDSLRAEDTAVYFCALGGGYAMDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7350 - protein, 1112 aa, Artificial Sequence
  Synthetic Polypeptide encoding a CAR with optional accessory module(s)
MEMLQGLLLLLLLSMGGAWASREPLRPWCHPINAILAVEKEGCPVCITVNTTICAGYCPTMMRVLQAVLPPLPQVVCTYRDVRFESIRLPGCPRGVDPVVSFPVALSCRCGPCRRSTSDCGGPKDHPLTCDHPQLSGLLFLLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEAPDVQDCPECTLQENPFFSQPGAPILQCMGCCFSRAYPTPLRSKKTMLVQKNVTSESTCCVAKSYNRVTVMGGFKVENHTACHCSTCYYHKSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7351 - protein, 1126 aa, Artificial Sequence
  Synthetic Polypeptide encoding a CAR with optional accessory module(s)
MALPVTALLLPLALLLHAARPDIQMTQSPASLSASVGETVTIICRASVNIYSYLAWYQQKQGKSPQLLVYNAKILAEGVPSRFSGSGSGTQFSLKINSLQPEDFGSYYCQHHYGTFTFGSGTKLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLKESGPGLVAPSQSLSITCTISGFSLTSYGVHWVRQPPGKGLEWLVVIWSDGSTTYNSALKSRLSISKDNSKSQVFLKMNSLQTDDTAIYYCASHYGSTLAFASWGHGTLVTVSAATRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7352 - protein, 1134 aa, Artificial Sequence
  Synthetic Polypeptide encoding a CAR with optional accessory module(s)
MALPVTALLLPLALLLHAARPDIVMTQSHKFMSTSVGDRVSVTCKASQNVGNNVAWYQQKPGQSPKVLIYSASYRYSGVPDRFTGSGSGTDFTLTISNVQSEDLAEYFCQQYNTYPFTFGSGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLEESGGGLVQPGGSMKLSCVASGFTFSNYWMNWVRQSPEKGLEWVAEIRFKSHNYATHFAESVKGRFTISRDDSKSSVYLQMNNLRAEDTGIYYCTRRIGNSDYDWWYFDVWGAGTSVTVSSASTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7353 - protein, 1130 aa, Artificial Sequence
  Synthetic Polypeptide encoding a CAR with optional accessory module(s)
MALPVTALLLPLALLLHAARPDDIQLTQSPSSLSASVGDRVTITCKASQSVDYEGDSFLNWYQQKPGKAPKLLIYAASNLESGVPSRFSGSGSGTDFTLTISSLQPEDFATYYCQQSNEDPLTFGQGTKVEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLVESGGGLVQPGGSLRLSCAASGYTFSSYWIEWVRQAPGKGLEWIGEILPGGGDTNYNEIFKGRATFSADTSKNTAYLQMNSLRAEDTAVYYCTRRVPIRLDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7354 - protein, 1136 aa, Artificial Sequence
  Synthetic Polypeptide encoding a CAR with optional accessory module(s)
MALPVTALLLPLALLLHAARPDQSVLTQPPSVSGAPGQRVTISCTGSSSNIGAGYDVHWYQQLPGTAPKLLIYGNSNRPSGVPDRFSGSKSGTSASLAITGLQAEDEADYYCQSYDNSLSSWVFGGGTKLTVLGQPKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLQQSGAEVKKPGSSVKVSCKASGGTFSSYAISWVRQAPGQGLEWMGRIIPILGIANYAQKFQGRVTITADKSTSTAYMELSSLRSEDTAVYYCARDVGSGSYSLDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7355 - protein, 1133 aa, Artificial Sequence
  Synthetic Polypeptide encoding a CAR with optional accessory module(s)
MALPVTALLLPLALLLHAARPDQSVVTQPPSVSAAPGRKVTISCSGSSSNIGSNYVSWYQQVPGTAPKLLIYEDDKRPSGIPDRFSGSKSGTSATLGITGLQTGDEADYFCATWDRTVNVVRFGGGTRLTVHSQPKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARHVGHELDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7356 - protein, 1127 aa, Artificial Sequence
  Synthetic Polypeptide encoding a CAR with optional accessory module(s)
MALPVTALLLPLALLLHAARPDIQMTQSPSSLSASVGDRVTITCRASQSISSYLNWYQQKPGKAPKLLIYAASSLQSGVPSGFSGSGSGTDFTLTISSLQPEDFATYYCQQSYSTPLTFGGGTKVEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCAREGKNGAFDIWGQGTMVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7357 - protein, 1152 aa, Artificial Sequence
  Synthetic Polypeptide encoding a CAR with optional accessory module(s)
MALPVTALLLPLALLLHAARPDEFDVQLVESGGGLVQPGGSLRLSCAASGFILDYYAIGWFRQAPGKEREGVLCIDASDDITYYADSVKGRFTISRDNSKNTVYLQMNSLRPEDTAVYYCATPIGLSSSCLLEYDYDYWGQGTLVTVSSLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEVQLVESGGGLVQPGGSLRLSCAASGRTYYLNAMGWFRQAPGKEREFVAAIDWSEGNKDYADSVKGRFTISRDNSKNTVYLQMNSLRPEDTAVYYCAADTPPWGPLIYIESYDSWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7358 - protein, 1127 aa, Artificial Sequence
  Synthetic Polypeptide encoding a CAR with optional accessory module(s)
MALPVTALLLPLALLLHAARPDQIVLTQSPAIMSASPGEKVTISCSASSSVSYMYWYQQKPGSSPKPWIYRTSNLASGVPARFSGSGSGTSYSLTISNMEAEDAAAYYCQQYHSYPTTFGGGTKLEVKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLVESGGGLVQPKGSLKLSCAASGFSFNTYAMNWVRQAPGKGLEWIAHIRSKSNNFATYYADSVKDRFSISRDASENILFLQMNNLKTEDTAMYYCVRQGGDFPMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7359 - protein, 1126 aa, Artificial Sequence
  Synthetic Polypeptide encoding a CAR with optional accessory module(s)
MALPVTALLLPLALLLHAARPDDIQMTQSSSSFSVSLGDRVTITCMASEDIYIRLAWYQQKPGNAPRLLISAATSLETGVPSRFSGSGSGKDYTLSITSLQTEDVGTYYCQQYWSSPWTFGGGTKLEINLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEDVQLQESGPGLVKPSQSLSLTCTVTGYSITSDYTWNWIRQFPGNKLEWMGYITYSGSTSYNPSLKSRNSITRDTSKNQFFLQLNSVTTEDTATYYCARLGRRYTMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7360 - protein, 1126 aa, Artificial Sequence
  Synthetic Polypeptide encoding a CAR with optional accessory module(s)
MALPVTALLLPLALLLHAARPDIQMTQSSSSFSVSLGDRVTITCKASEDIYIRLAWYQQKPGNAPRLLISAATSLETGIPSRFSGSGSGEDYTLTITSLQTEDVATYYCQQYWTTPWTFGGGTKLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEDVQLQESGPGLVKPSQSLSLTCTVTGYSITIDYTWNWIRQFPGNKLEWMGYITYSGSTDYNPSLKSRSSITRDTSMNQFFLQLNSVTTEDTATYYCARLGRRYALDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7361 - protein, 1127 aa, Artificial Sequence
  Synthetic Polypeptide encoding a CAR with optional accessory module(s)
MALPVTALLLPLALLLHAARPDIVMTQAAPSIPVTPGESVSISCRSDKSLLHSNGNTYLFWFLQRPGQSPQLLIYRMSNLASGVPDRFSGSGSGTAFTLRISGVEAEDVGVYYCMQHLEYPYTFGGGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLQQSGPELVKPGASVKMSCKASGYAFSSSWLNWVRQRPGKGLEWIGRIYPGDGENHYNGKFKGKATLTADKSSSTGYMQLSSLTSEDSAVYFCASYYEGGYWGQGTLITVSATRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7362 - protein, 1126 aa, Artificial Sequence
  Synthetic Polypeptide encoding a CAR with optional accessory module(s)
MALPVTALLLPLALLLHAARPDIVLTQSPASLAVSLGQSVTISCRASESVEYYGTSLMQWYQQKPGQPPKLLIYGASNVESGVPARFSGSGSGTDFSLNIHPVEEDDIAMYFCQQSRKVPWTFGGGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVKLVESGGGLVKPGGSRKLSCAASGFTFSSYTMSWVRQTPAKRLEWVATISSGSSTIYYADTVKGRFTISRDNAKNTLFLQMTSLRSEDTAMYYCARRWFLDCWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7363 - protein, 1129 aa, Artificial Sequence
  Synthetic Polypeptide encoding a CAR with optional accessory module(s)
MALPVTALLLPLALLLHAARPDQVQLQQSGPGLVKPSETLSLTCTVSGDSISSYYWSWIRQPPGKGLEWIGYIYYSGSTNYNPSLKSRVTISVDTSKSQFSLKLSSVTAADTAVYYCARGRYFDVWGRGTMVTSSLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFESSYVLTQPPSVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLGAAATRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7364 - protein, 1130 aa, Artificial Sequence
  Synthetic Polypeptide encoding a CAR with optional accessory module(s)
MALPVTALLLPLALLLHAARPDIVMTQSPLSLPVTPGEPASISCRSSKSLLHSNGNTYLYWFQQKPGQAPRLLIYRMSNLASGVPDRFSGSGSGTAFTLKISRVEAEDVGVYYCMQHIEYPFTFGQGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLVQSGPEVKKPGASVKVSCKASGYTFTNSWMNWVRQRPGKGLEWIGRIYPGDGETIYNGKFRVRVTITADESTSTAYMELSSLRSEDTAVYYCARGYDDYSFAYWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7365 - protein, 1130 aa, Artificial Sequence
  Synthetic Polypeptide encoding a CAR with optional accessory module(s)
MALPVTALLLPLALLLHAARPDEIVMTQSPATLSLSPGERATLSCRASQSVSSYLAWYQQKPGQAPRLLIYDASNRATGIPARFSGSGSGTDFTLTISSLEPEDFAVYYCHQYGSSPQTFGQGTKVEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLVQSGAEVKKPGSSVKVSCKASGGTFSSYAISWVRQAPGQGLEWMGGIIPIFGTANYAQKFQGRVTITADESTSTAYMELSSLRSEDTAVYYCAVHYGDYVFSSMDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7366 - protein, 1133 aa, Artificial Sequence
  Synthetic Polypeptide encoding a CAR with optional accessory module(s)
MALPVTALLLPLALLLHAARPDETTLTQSPGTLSLSPGERATLSCRASQSVSSSYLAWYQQKPGQAPRLLIYGASSRATGIPDRFSGSGSGTDFTLTISRLEPEDFAVYYCQQYGSSPRTFGQGTKVEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGPEYCINGVCSLDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7367 - protein, 1135 aa, Artificial Sequence
  Synthetic Polypeptide encoding a CAR with optional accessory module(s)
MALPVTALLLPLALLLHAARPDIELTQSPSSLAVSAGEKVTMSCKSSQSLLNSRTRKNQLAWYQQKPGQSPELLIYWASTRQSGVPDRFTGSGSGTDFTLTISSVQAEDLAVYYCQQSYNLLTFGPGTKLEVKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEVKLQESGGGFVKPGGSLKVSCAASGFTFSSYAMSWVRLSPEMRLEWVATISSAGGYIFYSDSVQGRFTISRDNAKNTLHLQMGSLRSGDTAMYYCARQGFGNYGDYYAMDYWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7368 - protein, 1134 aa, Artificial Sequence
  Synthetic Polypeptide encoding a CAR with optional accessory module(s)
MALPVTALLLPLALLLHAARPDIQMTQSPSSLSASVGDRVTITCRSSQNIVHSNGNTYLDWYQQTPGKAPKLLIYKVSNRFSGVPSRFSGSGSGTDFTFTISSLQPEDIATYYCFQYSHVPWTFGQGTKLQILEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLQQSGAEVKKPGSSVKVSCKASGYTFTNYYIYWVRQAPGQGLEWIGGINPTSGGSNFNEKFKTRVTITADESSTTAYMELSSLRSEDTAFYFCTRQGLWFDSDGRGFDFWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7369 - protein, 1190 aa, Artificial Sequence
  Synthetic Polypeptide encoding a CAR with optional accessory module(s)
MALPVTALLLPLALLLHAARPLFNQEVQIPLTESYCGPCPKNWICYKNNCYQFFDESKNWYESQASCMSQNASLLKVYSKEDQDLLKLVKSYHWMGLVHIPTNGSWQWEDGSILSPNLLTIIEMQKGDCALYASSFKGYIENCSTPNTYICMQRTVGGGGSGGGGDLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFELFNQEVQIPLTESYCGPCPKNWICYKNNCYQFFDESKNWYESQASCMSQNASLLKVYSKEDQDLLKLVKSYHWMGLVHIPTNGSWQWEDGSILSPNLLTIIEMQKGDCALYASSFKGYIENCSTPNTYICMQRTVGGGGSGGGGDTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7370 - protein, 1124 aa, Artificial Sequence
  Synthetic Polypeptide encoding a CAR with optional accessory module(s)
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVHLQESGPGLVKPSETLSLTCTVSDDSISSYYWSWIRQPPGKGLEWIGHISYSGSANYNPSLKSRVTISVDTSKNQFSLKLSSVTAADTAVYYCANWDDAFNIWGQGTMVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7371 - protein, 1126 aa, Artificial Sequence
  Synthetic Polypeptide encoding a CAR with optional accessory module(s)
MALPVTALLLPLALLLHAARPDVVMTQTPLTLSVTIGQPASISCKSSQSLLDSDGKTYLHWLLQRPGQSPKRLIFLVSKLDSGVPDRFTGSGSGTDFTLKISRVEAEDLGVYYCWQGTHFPQTFGGGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEVQLQESGPDLVKPSQSLSLTCTVTGYSITSGYSWHWIRQFPGNKLEWMGYIHYSGDTDYNPSLKSRFSITRDTSKNQFFLQLNSVTTEDTATYYCATPGGFVYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7372 - protein, 1128 aa, Artificial Sequence
  Synthetic Polypeptide encoding a CAR with optional accessory module(s)
MALPVTALLLPLALLLHAARPDQSELTQPRSVSGSPGQSVTISCTGTERDVGGYNYVSWYQQHPGKAPKLIIHDVIERSSGVPDRFSGSKSGNTASLTISGLQAEDEADYYCWSFAGGYYVFGTGTDVTVLLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEVQLLESGGGLVQPGGSLRLSCAASGFTFSTYQMSWVRQAPGKGLEWVSGIVSSGGSTAYADSVKGRFTISRDNSKNTLYLQMNSLRAEDTAVYYCAGELLPYYGMDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7373 - protein, 1129 aa, Artificial Sequence
  Synthetic Polypeptide encoding a CAR with optional accessory module(s)
MALPVTALLLPLALLLHAARPDQSELTQPRSVSGSPGQSVTISCTGTERDVGGYNYVSWYQQHPGKAPKLIIHDVIERSSGVPDRFSGSKSGNTASLTISGLQAEDEADYYCWSFAGGYYVFGTGTDVTVLLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLLESGGGLVQPGGSLRLSCAASGFTFSTYEMHWVRQAPGKGLEWVSVILSSGGETNYADSVKGRFTISRDNSKNTLYLQMNSLRAEDTAVYYCAGMLLPYYGMDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7374 - protein, 1192 aa, Artificial Sequence
  Synthetic Polypeptide encoding a CAR with optional accessory module(s)
MQIPQAPWPVVWAVLQLGWRPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7375 - protein, 1125 aa, Artificial Sequence
  Synthetic Polypeptide encoding a CAR with optional accessory module(s)
MALPVTALLLPLALLLHAARPDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7376 - protein, 1127 aa, Artificial Sequence
  Synthetic Polypeptide encoding a CAR with optional accessory module(s)
MALPVTALLLPLALLLHAARPAIVMTQTPSPVSAAVGGTVTINCQASESVYSNNYLSWFQQKPGQPPKLLIYLASTLASGVPSRFKGSGSGTQFTLTISGVQCDDAATYYCIGGKSSSTDGNAFGGGTEVVVRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQSLEESGGRLVKPDETLTITCTVSGIDLSSNGLTWVRQAPGEGLEWIGTINKDASAYYASWAKGRLTISKPSSTKVDLKITSPTTEDTATYFCGRIAFKTGTSIWGPGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7377 - protein, 1125 aa, Artificial Sequence
  Synthetic Polypeptide encoding a CAR with optional accessory module(s)
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLVQSGAEVKKPGASVKVSCKASGYTFTSYDVHWVRQAPGQRLEWMGWLHADTGITKFSQKFQGRVTITRDTSASTAYMELSSLRSEDTAVYYCARERIQLWFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7378 - protein, 1144 aa, Artificial Sequence
  Synthetic Polypeptide encoding a CAR with optional accessory module(s)
MALPVTALLLPLALLLHAARPDDIVMTQSPLSLPVTPGEPASISCRSSQSLLHSNGYNYLVWYLQKPGQSPQLLIYLGSIRASGVPDRFSGSGSGTDFTLKISRVEAEDVGVYYCMQPLQTPITFGQGTRLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEGLQCVAAPRWVLSQVQLQQWGAGLLKPSETLSLTCAVYGGSFSGNYWSWIRQPPGKGLEWIGEINHSGSTNYNPSLKSRVTISVDTSKNQFSLKLSSVTAADTAVYYCARGGSYNYFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7379 - protein, 1141 aa, Artificial Sequence
  Synthetic Polypeptide encoding a CAR with optional accessory module(s)
MALPVTALLLPLALLLHAARPDQLTQSPSSVSASVGDRVTITCRASRGISSWLAWYQQKPGKAPKLLIYTASSLQSGVPSRFSGSGSGTDFTLTISSLQPEDFATYYCQQAYSFPRTFGQGTKVEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEVAAPRWVLSQVQLQESGPGLVKPSQTLSLTCTVSGGSISSGGYYWIWIRQHPGKGLEWIGYIYYNGNTYYNPSLKSRVTMSVDTSKNQFSLKLSSVTAADTAVYYCARDGITMIRGYYYGMDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7380 - protein, 1115 aa, Artificial Sequence
  Synthetic Polypeptide encoding a CAR with optional accessory module(s)
MALPVTALLLPLALLLHAARPDIVVTQSPASLAVSLGQRATISYRASKSVSTSGYSYMHWNQQKPGQPPRLLIYLVSNLESGVPARFSGSGSGTDFTLNIHPVEEEDAATYYCQHIRELTRSEGGPSWKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVKLEESGGDLVKPGGSLKLSCAASGFTFSGYGMSWVRQTPDKRLEWVATISSGGSYTYYPDSVKGRFTISRDNAKNTLYLQMSSLKSEDTAMYYCARHEGGYYGSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7381 - protein, 1131 aa, Artificial Sequence
  Synthetic Polypeptide encoding a CAR with optional accessory module(s)
MALPVTALLLPLALLLHAARPDDIQMTQSPSSLSASVGDRVTITCRASQGISNYLAWYQQKTGKVPKFLIYEASTLQSGVPSRFSGGGSGTDFTLTISSLQPEDVATYYCQNYNSAPFTFGPGTKVDIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLVESGGGVVQPGRSLRLSCAASGFAFSRYGMHWVRQAPGKGLEWVAVIWYDGSNKYYADSVKGRFTISRDNSKNTQYLQMNSLRAEDTAVYYCARGGDFLYYYYYGMDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7382 - protein, 1122 aa, Artificial Sequence
  Synthetic Polypeptide encoding a CAR with optional accessory module(s)
MALPVTALLLPLALLLHAARPDIQMTQSPSSLSTSVGDRVTLTCKASQDVGTAVDWYQQKPGPSPKLLIYWASTRHTGIPSRFSGSGSGTDFTLTISSLQPEDFADYYCQQYNSYPLTFGPGTKVDIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLVQSGPEVKKPGATVKISCKTSGYTFTEYTIHWVKQAPGKGLEWIGNINPNNGGTTYNQKFEDKATLTVDKSTDTAYMELSSLRSEDTAVYYCAAGWNFDYWGQGTLLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7383 - protein, 1123 aa, Artificial Sequence
  Synthetic Polypeptide encoding a CAR with optional accessory module(s)
MALPVTALLLPLALLLHAARPDIQMTQSPSSLSASVGDRVTITCKASQDIYPYLNWFQQKPGKAPKTLIYRTNRLLDGVPSRFSGSGSGTDFTFTISSLQPYYCLQYDEFPLTFGAGTKLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQITLKESGPTLVKPTQTLTLTCTFSGFSLSTSNMGVGWIRQPPGKALEWLAHIWWDDDKYYSPSLKSRLTITKDTSKNQVVLTMTNMDPVDTATYYCVRSNYGYAWFAYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7384 - protein, 1123 aa, Artificial Sequence
  Synthetic Polypeptide encoding a CAR with optional accessory module(s)
MALPVTALLLPLALLLHAARPDIVMTQSQKFMSTSVGDRVNVTCKASQNVGTNVVWYQQKTGQSPKALIHSASYRYSGVPDRFTGSGSGTDFTLTLSNVQSEDLAEYFCQHYNSFPYTFGGGTKLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLQQSGAELVRPGVSVKISCKGSGYRFTDYPIHWVKQSHAKSLEWIGIISTYYGDVTNNPKFRGKATMTVDKSSTTAYMELARLTSEDSAIYYCARNDLFAYWGQGTLVTVSATRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7385 - protein, 1126 aa, Artificial Sequence
  Synthetic Polypeptide encoding a CAR with optional accessory module(s)
MALPVTALLLPLALLLHAARPDIKMTQSPSSMYASLGERVTITCKASPDINSYLSWFQQKPGKSPKTLIYRANRLVDGVPSRFSGGGSGQDYSLTINSLEYEDMGIYYCLQYDEFPYTFGGGTKLEMKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVKLVESGGGLVKPGGSLKLSCAASGFTFSSYAMSWVRQIPEKRLEWVASISRGGTTYYPDSVKGRFTISRDNVRNILYLQMSSLRSEDTAMYYCGRYDYDGYYAMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7386 - protein, 1129 aa, Artificial Sequence
  Synthetic Polypeptide encoding a CAR with optional accessory module(s)
MALPVTALLLPLALLLHAARPDDVVVTPVSCFLSCISGAEGHHLIQGQQKCQYIWLLYALEPTETRTATQTPHLSCIQPRIWGPCQVQWQWVWDRLHPQHPSCGGGGCCNLLLSAHGAYTFGGGTRLELKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVKLQESGPELVKPGASVKMSCKASGYTFTSYVMHWVKQKPGQGLEWIGYINPYNDGTKYNEKFKGKATLTSDKSSSTAYMELSSLTSEDSAVYYCARWKIYYGNYEDYWGQGTPLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7387 - protein, 1135 aa, Artificial Sequence
  Synthetic Polypeptide encoding a CAR with optional accessory module(s)
MALPVTALLLPLALLLHAARPDEFQVQLVQSGGGLVQPGGSLRLSCAASDFDFAAYEMSWVRQAPGQGLEWVAIISHDGIDKYYTDSVKGRFTISRDNSKNTLYLQMNTLRAEDTATYYCLRLGAVGQGTLVTVSSLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLVQSGGGLVQPGGSLRLSCAASDFAFDDYEMSWVRQAPGKALEWIGDINHSGTTIYNPSLKSRVTISRDNSKNTLYLQMNTLRAEDTAIYYCARPHYGDYSDAFDIWGQGTMVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7388 - protein, 1134 aa, Artificial Sequence
  Synthetic Polypeptide encoding a CAR with optional accessory module(s)
MALPVTALLLPLALLLHAARPEIVMTQSPATLSVSPGERATLSCRASQSVSSNLAWYQQKPGQAPRLLIYGASTRATGIPARFSGSGSGTDFTLTISSLQSVDSAVYYCQQYNNWPPYTFGQGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLLESGGGVVQPGRSLRLSCAASGFTFSFYGMHWVRQAPGKGLEWVAAISYDGSNKYYADSVKGRFTISRDNSKNTLYLQMNSLRAEDTAVYYCAKRPNQFYCSDGRCYSIDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7389 - protein, 1130 aa, Artificial Sequence
  Synthetic Polypeptide encoding a CAR with optional accessory module(s)
MALPVTALLLPLALLLHAARPQSVLTQPPSASAGGTPGQRVTISCSGSSSNIGSNFVYWYQQLPGTAPKLLIYRNNQRPSGVPDRFSGSRSGTSASLAGLRSEDEADYYCAADSLGGHYVFGTGTKVLLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLVESGGGSVQPGRSLRLSCEASGFTFEAYAMHWVRQPPGKGLEWVSSINWNSGRIAYADSVKGRFTISRDNARNSLYLQMNSLRLEDTAFYYCAKDIRRFSTGGAEFEYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7390 - protein, 1125 aa, Artificial Sequence
  Synthetic Polypeptide encoding a CAR with optional accessory module(s)
MALPVTALLLPLALLLHAARPENVLTQSPAIMSASPGEKVTMTCSASSSVSYMHWYQQKSSTSPKLWIYDTSKLASGVPGRFSGSGSGNSYSLTISSMEAEDVATYYCFQGSGYPLTFGAGTKLELKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLKESGPGLVAPSQSLSITCTVSGFSLSSQGVYWVRQPPGKGLEWLGAIWAGGSTNYNSALMSRLSISKDNSKSQVFLKMNSLQTDDTAMYYCARVDGYRGYNMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7391 - protein, 1136 aa, Artificial Sequence
  Synthetic Polypeptide encoding a CAR with optional accessory module(s)
MALPVTALLLPLALLLHAARPDVVMTQSPLSLPVTPGEPASISCRSSQSLLHSNGHNYLDWYLQKPGQSPQLLIYLGSNRASGVPDRFSGSGSGTDFTLKISRVEAEDVGVYYCMQTLQTPLTFGPGTKVDIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLVETGGGVVQPGRSLRLSCAASGFTFSSYGMHWVRQAPGKGLEWVAVISYDGSNKYYADSVKGRFTISRDNSKNTLYLQMNSLRAEDTAVYYCAKDRYGWGSSFGHFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7392 - protein, 1129 aa, Artificial Sequence
  Synthetic Polypeptide encoding a CAR with optional accessory module(s)
MALPVTALLLPLALLLHAARPDDIQMTQSPSSLSASVGDRVTITCRASQSISSYLNWYQQKPGKAPKLLIYDASNLETGVPSRFSGSGSGTDFTFTISSLQPEDIATYYCQQYDNLPLTFGGGTKVDIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARAHNSSSWSFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7393 - protein, 1138 aa, Artificial Sequence
  Synthetic Polypeptide encoding a CAR with optional accessory module(s)
MALPVTALLLPLALLLHAARPDDVVMTQSPLSLPVSLGDQASISCRSSQRLVHSNGNTYLHWYLQKPGQSPKLLIYRVSNRFPGVPDRFSGSGSGTDFTLKISRVEAEDLGIYFCSQSTHVPYTFGGGTKLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVRLQQSGPDLIKPGASVKMSCKASGYTFTGYVMHWVKQRPGQGLEWIGFINPYNDDIQSNERFRGKATLTSDKSSTTAYMELSSLTSEDSAVYYCARGAGYNFDGAYRFFDFWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7394 - protein, 1129 aa, Artificial Sequence
  Synthetic Polypeptide encoding a CAR with optional accessory module(s)
MALPVTALLLPLALLLHAARPDSYELTQPPSVSVSPGQTATISCSGDQLGGKYGHWYQKKPGQSPVLVLYQDRKRPAGIPERFSGSSSGNTITLTISGTQAVDEADYYCQAWDTNLGGVFGGGTKVTVLGQLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLVESGAEVKKPGASVKVSCKASGYTFTGYYMHWVRQAPGQGLEWMGRINPNSGGTNYAQKFQGRVTMTRDTSISTAYMELSRLRSDDTAVYYCASPRGRGSAFDIWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7395 - protein, 1132 aa, Artificial Sequence
  Synthetic Polypeptide encoding a CAR with optional accessory module(s)
MALPVTALLLPLALLLHAARPDNFMLTQPHSVSESPGKTVTISCTRSSGSIASKYVQWYQQRPGSSPTTVIYEDNQRPSGVPDRFSGSIDTSSNSASLTISGLRTEDEADYYCHSYDSNNHSVFGGGTKVTVLGQLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLVESGGGVVQPGGSLRLSCAASGFTFSSYAMSWVRQAPGKGLEWVSAISGSGGSTYYADSVKGRFSISRDNSKNTLYLQMNSLRAEDTAVYYCARTRSSGAFDIWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7396 - protein, 1127 aa, Artificial Sequence
  Synthetic Polypeptide encoding a CAR with optional accessory module(s)
MALPVTALLLPLALLLHAARPDIQMNQSPSSLSASLGDTITITCHASQNINVWLSWYQQKPGNIPKLLIYKASNLHTGVPSRFSGSGSGTGFTITISSLQPEDIATYYCQQGQSYPWTFGGGTKLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLQQSGPELVKPGASVKISCKASGYSFTGYFMNWVKQSHGKSLEYIGRFNPYNGETLYNQKFKGKATLTVDKSSSTVHMELLSVTSEDSAVYYCGRSGNDDAMDYWGQGTSVTVSSATRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7397 - protein, 1128 aa, Artificial Sequence
  Synthetic Polypeptide encoding a CAR with optional accessory module(s)
MALPVTALLLPLALLLHAARPDDIQMTQSPSILSASVGDRVTITCRASQRFGDYLAWYQQKPGQAPKLLIYGASTLQSGVPSRFSGSGSGTEFTLTISGLQPEDFATYYCQQANSFPITFGKGTRLDIRRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLVQSGAEVKKPGSSVKVSCKASGGTFSSYAISWVRQAPGQGLEWMGWINVGNGNAIYSQKFQGRVTITRDTSATTAYMELSSLRSEDTAVYYCARDGERAWDLDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7398 - protein, 1133 aa, Artificial Sequence
  Synthetic Polypeptide encoding a CAR with optional accessory module(s)
MALPVTALLLPLALLLHAARPDETTLTQSPGTLSLSPGERATLSCRASQSVSSSYLAWYQQKPGQAPRLLIYGASSRATGIPDRFSGSGSGTDFTLTISRLEPEDFAVYYCQQYGSSPYTFGQGTKLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLVQSGGGVVQPGRSLRLSCAASGFTFSSYAMHWVRQAPGKGLEWVAVISYDGSNKYYADSVKGRFTISRDNSKNTLYLQMNSLRAEDTAVYYCARELRFLEWSSDAFDIWGQGTMVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7399 - protein, 1128 aa, Artificial Sequence
  Synthetic Polypeptide encoding a CAR with optional accessory module(s)
MALPVTALLLPLALLLHAARPEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTMIRGVIDSWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7400 - protein, 1137 aa, Artificial Sequence
  Synthetic Polypeptide encoding a CAR with optional accessory module(s)
MALPVTALLLPLALLLHAARPDIVMTQTPLSLPVTPGEPASISCRSSRSLLDSDDGNTYLDWYLQKPGQSPQLLIYTLSYRASGVPDRFSGSGSGTDFTLKISRVEAEDVGVYYCMQRVEFPITFGQGTRLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLVESGGGVVQPGRSLRLSCAASGFIFSRYGMHWVRQAPGKGLKWVAVIWYDGSNKLYADSVKGRFTISRDNSKNTLYLQMNSLRAEDTAVYYCARDYYDNSRHHWGFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7401 - protein, 1127 aa, Artificial Sequence
  Synthetic Polypeptide encoding a CAR with optional accessory module(s)
MALPVTALLLPLALLLHAARPEIQMTQSPSSMSASLGDTITITCQATQDIFKNLNWYQQKPGKPPSLLIYYATELAEGVPSRFSGSGSGSDYSLTISNLESEDFAAYYCLQFFEFPFTFGSGTKLEMKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLQQSGAELVRPGTSVKVSCKASGYVFTNYWIEWIKQRPGQGLEWIGVMNPGSGETTYNEKFKGKATLTADKSSSTAYMQLSSLTSVDSAVYFCARDHDRDYYAMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7402 - protein, 1124 aa, Artificial Sequence
  Synthetic Polypeptide encoding a CAR with optional accessory module(s)
MALPVTALLLPLALLLHAARPDILLTQSPAILSVSPGERVSFSCRASQNIGTSIHWYQQRTNGSPRLLIKYASESVSGIPSRFSGSGSGTDFTLSINSVESEDIADYYCQHTNSWPTTFGGGTKLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLQQSDAELVKPGASVKISCKASGYTFTDHAIHWVKQKPEQGLEWIGYFSPGNGDIKYNEKFKGKATLTADKSSSTAYMQLNSLTSEDSAVYFCKRSYGNYDYWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7403 - protein, 1129 aa, Artificial Sequence
  Synthetic Polypeptide encoding a CAR with optional accessory module(s)
MALPVTALLLPLALLLHAARPDIVMTQSPDSLAVSLGERATINCKSSQSLLNSGDQKNYLTWYQQKPGQPPKLLIYWASTRESGVPDRFSGSGSGTDFTLTISSLQAEDVAVYYCQNDYSYPLTFGQGTKVEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLVQSGAEVKKTGSSVKVSCKASGYTFTDHAIHVWRQAPGQALEWMGHFSPGNTDIKYNDKFKGRVTLTVDRSMSTAYMELSSLRSEDTAMYYCKTSTFFFDYWGQGTMVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7404 - protein, 1128 aa, Artificial Sequence
  Synthetic Polypeptide encoding a CAR with optional accessory module(s)
MALPVTALLLPLALLLHAARPDIQMTQSPSSLSASVGDRVTITCKASQDVSIAVAWYQQKPGKAPKVLIYSASYRYTGVPDRFSGSGSGTDFTFTISSLQPEDIAVYYCQQHYITPLTFGGGTKVEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQIQLVQSGHEVKKPGASVKVSCKASGYTFTNYGMNWVRQAPGQGLEWMGWINTKTGEPTYAEEFKGRFVFSLETSASTAYLQISSLKAEDTAMYFCGRGGYGSSYWYFDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7405 - protein, 1130 aa, Artificial Sequence
  Synthetic Polypeptide encoding a CAR with optional accessory module(s)
MALPVTALLLPLALLLHAARPDIVMTQSPDSLAVSLGERATINCRASKSVSTSGYSYMHWYQQKPGQPPKLLIYLASNLESGVPDRFSGSGSGTDFTLTISSLQAEDVAVYYCQHSRELPYTFGQGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLQESGPGLVKPSETLSLTCTVSGGSISSYGVHWIRQPPGKGLEWIGVIWTSGVTDYNSALMGRVTISVDTSKNQFSLKLSSVTAADTAVYYCARDGDYDRYTMDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7406 - protein, 1109 aa, Artificial Sequence
  Synthetic Polypeptide encoding a CAR with optional accessory module(s)
MTALFLMSMLFGLACGQAMSFCIPTEYTMHIERRECAYCLTINTTICAGYCMTRDINGKLFLPKYALSQDVCTYRDFIYRTVEIPGCPLHVAPYFSYPVALSCKCGKCNTDYSDCIHEAIKTNYCTKPQKSYLVGFSVLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEAPDVQDCPECTLQENPFFSQPGAPILQCMGCCFSRAYPTPLRSKKTMLVQKNVTSESTCCVAKSYNRVTVMGGFKVENHTACHCSTCYYHKSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7407 - protein, 1126 aa, Artificial Sequence
  Synthetic Polypeptide encoding a CAR with optional accessory module(s)
MALPVTALLLPLALLLHAARPQSVLTQPPSVSVSPGQTASITCSGDKLGDKYACWYQQKPGQSPVLVIYQDSKRPSGIPERFSGSNSGNTATLTISGTQAMDEADYYCQAWDSSTAVVFGGGTKLTVLLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLVQSGAEVKKPGQSLKISCKASGYSLTDNWIGWVRQKPGKGLEWMGIIYPGDSDTRYSPSFQGQVTISADKSINTAYLQWSSLKASDTAIYYCVGLDWNYNPLRYWGPGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7408 - protein, 1124 aa, Artificial Sequence
  Synthetic Polypeptide encoding a CAR with optional accessory module(s)
MALPVTALLLPLALLLHAARPDIVMTQSQKFMSTSVGDRVSIICKASQNVGTFVAWYQQKPGQSPKLLVYSASNRYTGVPDRFTGSGSGTDFTLTINNMQSEDLADYFCRQYSSYPYTFGGGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLQQSGPELVKPGASMKISCKASGYSFSAYTMNWVKQSHGKNLEWIGLINPYNGGTNYNQEFEGKATLTVNKSSNTAFMELLSLTSDDSAVYYCARRDWDYFDYWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7409 - protein, 1135 aa, Artificial Sequence
  Synthetic Polypeptide encoding a CAR with optional accessory module(s)
MALPVTALLLPLALLLHAARPAIQMTQSPSSLSASVGDRVTITCRASQSISNYLNWYQQKPGKAPKLLIYAASSLQSGVPSRFSGSGSGTDFTLTISSLQPEDFATYYCQQSYSSPSTTFGQGTKLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLVESGGGLIQPGGSLRLSCAASGFTVSSNYMSWVRQAPGKGLEWVSVTYSGGSTSYADSVKGRFTISRDNSKNTLYLQMNSLRAEDTAVYYCARGGRYCSSISCYARSGCDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7410 - protein, 1130 aa, Artificial Sequence
  Synthetic Polypeptide encoding a CAR with optional accessory module(s)
MALPVTALLLPLALLLHAARPDIQMTQSPSSLSASVGDRVTITCRASQSIGTSLHWYQQKPGKAPKLLIKFASRLQSGVPSRFSGSGSGTDFTLTISSLQPEDFATYYCQQSPGFPPTFGQGTKLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLVESGGGLVKPGGSLRLSCAASGFSITTSGYYWTWIRQFPGKGLEWMGYIGYNSKTYYNPALKSRITISRDNAKNSLYLQMNSLRAEDTAVYYCARSLYGGYKDAFDSWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7411 - protein, 1135 aa, Artificial Sequence
  Synthetic Polypeptide encoding a CAR with optional accessory module(s)
MALPVTALLLPLALLLHAARPDEIVLTQSPLSLPVTPGEPASISCRSSQSLLHSIGYNYLDWYLQKPGQSPQLLIYLGSNRASGVPDRFSGSGSGTDFTLKISRVEAEDVGVYYCMQALQTPLTFGGGTKVEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLVESGGGVVQPGRSLRLSCAASGFTFRSYGMHWVRQAPGKGLEWVAVISYDGSNKYYTDSVNGRFTISRDNSKNTLYLQMNSLRAEDTAVYYCARGGGYYETSGPDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7412 - protein, 1133 aa, Artificial Sequence
  Synthetic Polypeptide encoding a CAR with optional accessory module(s)
MALPVTALLLPLALLLHAARPDDVVMTQSPLSLPVTPGEPASISCRSSQSLLHSIGYNYLHWFLQKPGQSPQLLIYLGSNRASGVPDRFSGSGSGTDFTLKISRVEAEDVGVYYCMQALQTPPTFGQGTRLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQLQLQESGPGLVKPSGTLSLTCAVSGGSISSSNWWSWVRQPPGKGLEWIGEIYHSGSTNYNPSLKSRVTISVDKSKNQFSLKLSSVTAADTAVYYCVGSPYGDYVLDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7413 - protein, 1135 aa, Artificial Sequence; identical to SEQ ID NO: 7411
  Synthetic Polypeptide encoding a CAR with optional accessory module(s)

SEQ ID NO: 7414 - protein, 1131 aa, Artificial Sequence
  Synthetic Polypeptide encoding a CAR with optional accessory module(s)
MALPVTALLLPLALLLHAARPDEIVLTQSPGTLSLSLGERATLSCRASQSISSSFLAWYQQKPGQAPKLLIYAASTRATGIPDRFSGSGSGTDFTLTISRLEPEDFAVYYCQQYGRSLSFGGGTKVEVKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLQQSGPGLVKPSQTLSLTCAISGDSVSGNSATWNWIRQSPSRGLEWLGRTYYRSKWNHDYAESVKSRITINPDTSKNQFSLQLNSVTPEDTAVYYCARGDSSSWYAFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7415 - protein, 1131 aa, Artificial Sequence
  Synthetic Polypeptide encoding a CAR with optional accessory module(s)
MALPVTALLLPLALLLHAARPDQTVVTQPPSASGTPGQRVTISCSGSSSNIGSNYVYWYQQLPGTAPKLLIYRSNQRPSGVPDRFSGSKSGTSASLAISGPRSVDEADYYCAAWDDSLNGVVFGGGTKLTVLGLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARRIPPYYGMDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7416 - protein, 1130 aa, Artificial Sequence
  Synthetic Polypeptide encoding a CAR with optional accessory module(s)
MALPVTALLLPLALLLHAARPDQSVVTQPPSVSVAPGKTARITCGRNNIGSKSVHWYQQKPGQAPVLVVYDDSDRPSGIPERFSGSNSGNTATLTISRVEAGDEADYYCQVWDSSSDHVVFGGGTKLTVLGLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEVQLVQSGGGVMRPGGSLRLSCAASGFTFDDYGMSWVRQAPGKGLEWVSGINWNGGSTGYADSVRGRFTISRDNAKNSLYLQMNSLRAEDTALYYCARERGYGYHDPHDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7417 - protein, 1143 aa, Artificial Sequence
  Synthetic Polypeptide encoding a CAR with optional accessory module(s)
MALPVTALLLPLALLLHAARPEQKLISEEDLEFQAVVTQPPSASGTPGQRVTISCSGSSSNIGSNTVNWYQQVPGTAPKLLIYSNNQRPSGVPDRFSGSKSGTSASLAISGLQSEDEADYYCAAWDDSLNGWVFGGGTKLTVLLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQMQLVQSGAEVKEPGESLRISCKGSGYSFTNFWISWVRQMPGKGLEWMGRVDPGYSYSTYSPSFQGHVTISADKSTSTAYLQWNSLKASDTAMYYCARVQYSGYYDWFDPWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7418 - protein, 1137 aa, Artificial Sequence
  Synthetic Polypeptide encoding a CAR with optional accessory module(s)
MALPVTALLLPLALLLHAARPEQKLISEEDLEFDIQMTQSPSTLSASVGDRVTITCRASQNINKWLAWYQQRPGKAPQLLIYKASSLESGVPSRFSGSGSGTEYTLTISSLQPDDFATYYCQQYNSYATFGQGTKVEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLVQSGAEVKKPGESLKISCKGSGYNFSNKWIGWVRQLPGRGLEWIAIIYPGYSDITYSPSFQGRVTISADTSINTAYLHWHSLKASDTAMYYCVRHTALAGFDYWGLGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7419 - protein, 1129 aa, Artificial Sequence
  Synthetic Polypeptide encoding a CAR with optional accessory module(s)
MALPVTALLLPLALLLHAARPDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7420 - protein, 1128 aa, Artificial Sequence
  Synthetic Polypeptide encoding a CAR with optional accessory module(s)
MALPVTALLLPLALLLHAARPDEIVLTQSPGTLSLSPGERATLSCRASQSVSNTYLAWYHQRPGQAPRLLIYGASSRATGIPDRFSGSGSGTDFALTISSLEPEDFAVYYCQQYSNSWTFGQGTKVEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLVESGGGVVQPGRSLRLSCAASGFTFSSYDMHWVRQAPGKGLEWVAVISYDGTNEYYADSVKGRFTISRDTSKNTLYLQMNSLRAEDTAVYYCARERYFDWSFDYWGQGTLVSVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7421 - protein, 1127 aa, Artificial Sequence
  Synthetic Polypeptide encoding a CAR with optional accessory module(s)
MALPVTALLLPLALLLHAARPDELTQDPAVSVALGQTVRITCQGDSLRSNYANWYQQKPGQAPVLVIYGQNNRPSGIPDRFSGSSSGNTASLTITGAQAADEADYYCDSRVSTGNHVVFGGGTKLTVLGQLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLVQSGAEVKKPGASVKVSCKASGYTFTSYAMHWVRQAPGQRLEWMGWINAGNGNTKYSQKFQGRVTITRDTSASTAYMELSSLRSEDTAVYYCARDISYGSFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7422 - protein, 1129 aa, Artificial Sequence
  Synthetic Polypeptide encoding a CAR with optional accessory module(s)
MALPVTALLLPLALLLHAARPDDIVLTQTPATLSVTPGDSVSLSCRASQSISNNLHWYQQKSHESPRLLIKNASQSISGIPSKFSGSGSGTDFTLRINSVETEDFGMYFCQQSNSWPYTFGSGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVKLQQSGPELVKPGASVKISCKASGYSFTGYYMHWVKQSHGNILDWIGYIYPYNGVSSYNQKFKGKATLTVDKSSSTAYMELRSLTSEDSAVYYCARERGLYQLRAMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7423 - protein, 1120 aa, Artificial Sequence
  Synthetic Polypeptide encoding a CAR with optional accessory module(s)
MALPVTALLLPLALLLHAARPDDIVMTQTPAIMSASPGQKVTITCSASSSVNYMHWYQQKLGSSPKLWIYDTSKLAPGVPARFSGSGSGTSYSLTISSMEAEDAASYFCHQWSSYPYTFGSGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLQESGPDLVKPSQSLSLTCTVTGYSITSGYGWHWIRQFPGNKLEWMGYIHYSGSTTYNPSLKSRISISRDTSKNQFFLQLNSVTTEDTATYYCARSLRYWGQGTTLTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7424 - protein, 1123 aa, Artificial Sequence
  Synthetic Polypeptide encoding a CAR with optional accessory module(s)
MALPVTALLLPLALLLHAARPDDIQMTQSPSSLSASVGDRVTITCSATSSISYMHWYQQKPGKAPKGWIYDTSKLAHGVPSRFSGSGSGTDFTLTISSLQPEDFATYYCHQRRSYPFTFGQGTKVEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLVQSGAEVKKPGASVKVSCKASGYTFTNFWIHWVRQAPGQGLEWIGEIDPSDSYTNYNQKFKGRVTITRDTSTSTAYLELSSLRSEDTAVYYCAREITTVDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7425 - protein, 1130 aa, Artificial Sequence
  Synthetic Polypeptide encoding a CAR with optional accessory module(s)
MALPVTALLLPLALLLHAARPDDIQMTQSPSSLSASVGDRVTITCKASQGFNKYVAWYQQKPGKAPKLLIYYTSTLQPGVPSRFSGSGSGRDYTLTISSLQPEDFATYYCLQYGNLLYAFGQGTKVEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLVQSGAEVKKPGASVKVSCKASGYTFTSYWIGWVRQAPGQGLEWIGDIYPGGGYTNYNEKFKGRVTITRDTSTSTAYLELSSLRSEDTAVYYCARLDGSSYRGAMDSWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7426 - protein, 1134 aa, Artificial Sequence
  Synthetic Polypeptide encoding a CAR with optional accessory module(s)
MALPVTALLLPLALLLHAARPDDIQLTQSPSSLSASVGDRVTITCRASQSVDYDGDSYMNWYQQKPGKAPKLLIYAASYLESGVPSRFSGSGSGTDFTLTISSLQPEDFATYYCQQSHEDPYTFGQGTKVEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLVESGGGLVQPGGSLRLSCAVSGYSITSGYSWNWIRQAPGKGLEWVASITYDGSTNYNPSVKGRITISRDDSKNTFYLQMNSLRAEDTAVYYCARGSHYFGHWHFAVWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7427 - protein, 1126 aa, Artificial Sequence
  Synthetic Polypeptide encoding a CAR with optional accessory module(s)
MALPVTALLLPLALLLHAARPDDIQMTQSPSSLSASVGDRVTITCRASQDIRYYLNWYQQKPGKAPKLLIYVASSLQSGVPSRFSGSGSGTEFTLTVSSLQPEDFATYYCLQVYSTPRTFGQGTKVEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLVESGGGLAKPGGSLRLSCAASGFRFTFNNYYMDWVRQAPGQGLEWVSRISSSGDPTWYADSVKGRFTISRENAKNTLFLQMNSLRAEDTAVYYCASLTTGSDSWGQGVLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7428 - protein, 1126 aa, Artificial Sequence
  Synthetic Polypeptide encoding a CAR with optional accessory module(s)
MALPVTALLLPLALLLHAARPEIVMTQSPATLSVSPGERATLSCRASQSVSRNLAWYQQKPGQAPRLLIYGASTRATGIPARFSGSGSGTEFTLTIGSLQSEDFAVYYCQQYKTWPRTFGQGTNVEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLQQWGAGLLKPSETLSLTCAVFGGSFSGYYWSWIRQPPGKGLEWIGEINHRGNTNDNPSLKSRVTISVDTSKNQFALKLSSVTAADTAVYYCARERGYTYGNFDHWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7429 - protein, 1127 aa, Artificial Sequence
  Synthetic Polypeptide encoding a CAR with optional accessory module(s)
MALPVTALLLPLALLLHAARPEIVMTPSSATLSVSPGERATLSCRASQSVSRNLAWYQQKPGQAPRLLIYGASTRATGIPARFSGSGSGTEFTLTISSLQSEDFAVYYCHQYSNWMCSFGQGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLLESGGGLVQPGGSLRLSCAASGFTFSRYAMNWVRQAPGKGLEWVSGISGSGGRTYYADSVKGRFTISRDNSKNTLYLQMNSLRAEDTAVYYCAKDRDFWSGPFDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7430 - protein, 1132 aa, Artificial Sequence
  Synthetic Polypeptide encoding a CAR with optional accessory module(s)
MALPVTALLLPLALLLHAARPDIQMTQSPSSLSASVGDRVTITCKASKNIRSYLAWYQQKPGKAPKLLIYSGSTLHSGVPSRFSGSGSGTDFTLTISSLQPEDFATYYCQQHHEYPLTFGQGTKVEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLQESGPGLVKPSETLSLTCTVSGYTITSGYDWSWIRQPPGKGLEWIGYINYGGSTNYKPSLGSRVTISVDTSKNQFSLKLSSVTAADTAVYYCARYNEYKSYIYDWYFDFWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7431 - protein, 1155 aa, Artificial Sequence
  Synthetic Polypeptide encoding a CAR with optional accessory module(s)
MALPVTALLLPLALLLHAARPELVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEGEINHRGNTNDNPSLKSRVTISVDTSKNQFALKLSSVTAADTAVYYCARERGYTYGNFDHWGQGTLVTVSSGEINHRGNTNDNPSLKSRVTISVDTSKNQFALKLSSVTAADTAVYYCARERGYTYGNFDHWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7432 - protein, 1130 aa, Artificial Sequence
  Synthetic Polypeptide encoding a CAR with optional accessory module(s)
MALPVTALLLPLALLLHAARPSSELTQDPAVSVALGQTVRITCQGDSLRSYYASWYQQKPGQAPVLVIYGKNNRPSGIPDRFSGSSSGNTASLTITGAQAEDEADYYCNSRDSSGWVFGGGTKLTVLLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDKGGGYYDFWSGSDYWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7433 - protein, 1139 aa, Artificial Sequence
  Synthetic Polypeptide encoding a CAR with optional accessory module(s)
MALPVTALLLPLALLLHAARPQSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLVYVFGTGTKVTVLLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLQQSGPGLVKPSQTLSLTCAISGDSVLSNSDTWNWIRQSPSRGLEWLGRTYHRSTWYDDYASSVRGRVSINVDTSKNQYSLQLNAVTPEDTGVYYCARDRLQDGNSWSDAFDVWGQGTMVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7434 - protein, 1132 aa, Artificial Sequence
  Synthetic Polypeptide encoding a CAR with optional accessory module(s)
MALPVTALLLPLALLLHAARPQSVLTQPRSVSGSPGQSVTISCTGTSSDVGGYNYVSWYQQHPGEAPKLIIYDADKRPSGISNRFSSGKSGNTASLTISGLQVEDEADYYCCSYAGGSTWVFGGGTKVTVLLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARGDSNYWSYYGMDVWGQGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7435 - protein, 1139 aa, Artificial Sequence
  Synthetic Polypeptide encoding a CAR with optional accessory module(s)
MALPVTALLLPLALLLHAARPQSALTQPASVSGSPGQSITISCTGTSSDVGGYNYVSWYQQHPGKAPKVIISEVNNRPSGVSHRFSGSKSGNTASLTISGLQAEDEADYFCSSYTSGRTLYVFGTGSKVTVLGLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLQQSGPGLVKPSQTLSLTCAISGDSVSSNSAAWNWIRQSPSRGLEWLGRTYYRSKWYSDYAVSVKSRITINPDTSKNQFSLQLNSVTPEDTAVYYCARDPYDFWSGYPDAFDIWGQGTMVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7436 - protein, 1138 aa, Artificial Sequence
  Synthetic Polypeptide encoding a CAR with optional accessory module(s)
MALPVTALLLPLALLLHAARPEVQLQQSGPGLVKPSQTLSLTCAISGDSMLSNSDTWNWIRQSPSRGLEWLGRTYHRSTWYDDYASSVRGRVSINVDTSKNQYSLQLNAVTPEDTGVYYCARVRLQDGNSWSDAFDVWGQGTMVTVSSLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQSALTQPASASGSPGQSVTISCTGTSSDVGGYNYVSWYQQHPGKAPKLMIYDVSNRPSGVSNRFSGSKSGNTASLTISGLQAEDEADYYCSSYTSSSTLYVFGTGTQLTVLTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIEPPDFCCPKCQYQAPDMDTLQIHVMECIE

SEQ ID NO: 7437 - protein, 673 aa, Artificial Sequence
  Synthetic Polypeptide encoding a CAR with optional accessory module(s)
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSRVDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 7438 - protein, 450 aa, Artificial Sequence
  Synthetic Polypeptide encoding a CAR with optional accessory module(s)
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSRVDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 7439 - protein, 636 aa, Artificial Sequence
  Synthetic Polypeptide encoding a CAR with optional accessory module(s)
MALPVTALLLPLALLLHAARPDVVMTQSPSSLSASVGDRVTITCMASEDIYIRLAWYQQKPGNAPKLLIYAATSLETGVPSRFSGSGSGTDFTLTISSLQPEDFATYYCQQYWSSPWTFGGGTKVEIKGGGGSGGGGSGGGGSQVQLQESGPGLVKPSQTLSLTCTVSGYSITSDYTWNWIRQPPGNGLEWIGYITYSGSTSYNPSLKSRVLISVDTSKNQVSLKLSSVTAADTAVYYCARLGRRYTMDYWGQGTTVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 7440 - protein, 413 aa, Artificial Sequence
  Synthetic Polypeptide encoding a CAR with optional accessory module(s)
MALPVTALLLPLALLLHAARPDVVMTQSPSSLSASVGDRVTITCMASEDIYIRLAWYQQKPGNAPKLLIYAATSLETGVPSRFSGSGSGTDFTLTISSLQPEDFATYYCQQYWSSPWTFGGGTKVEIKGGGGSGGGGSGGGGSQVQLQESGPGLVKPSQTLSLTCTVSGYSITSDYTWNWIRQPPGNGLEWIGYITYSGSTSYNPSLKSRVLISVDTSKNQVSLKLSSVTAADTAVYYCARLGRRYTMDYWGQGTTVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNK

SEQ ID NO: 7441 - protein, 671 aa, Artificial Sequence
  Synthetic Polypeptide encoding a CAR with optional accessory module(s)
MALPVTALLLPLALLLHAARPDVVMTQSPSSLSASVGDRVTITCMASEDIYIRLAWYQQKPGNAPKLLIYAATSLETGVPSRFSGSGSGTDFTLTISSLQPEDFATYYCQQYWSSPWTFGGGTKVEIKGGGGSGGGGSGGGGSQVQLQESGPGLVKPSQTLSLTCTVSGYSITSDYTWNWIRQPPGNGLEWIGYITYSGSTSYNPSLKSRVLISVDTSKNQVSLKLSSVTAADTAVYYCARLGRRYTMDYWGQGTTVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 7442 - protein, 448 aa, Artificial Sequence
  Synthetic Polypeptide encoding a CAR with optional accessory module(s)
MALPVTALLLPLALLLHAARPDVVMTQSPSSLSASVGDRVTITCMASEDIYIRLAWYQQKPGNAPKLLIYAATSLETGVPSRFSGSGSGTDFTLTISSLQPEDFATYYCQQYWSSPWTFGGGTKVEIKGGGGSGGGGSGGGGSQVQLQESGPGLVKPSQTLSLTCTVSGYSITSDYTWNWIRQPPGNGLEWIGYITYSGSTSYNPSLKSRVLISVDTSKNQVSLKLSSVTAADTAVYYCARLGRRYTMDYWGQGTTVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 7443 - protein, 646 aa, Artificial Sequence
  Synthetic Polypeptide encoding a CAR with optional accessory module(s)
MALPVTALLLPLALLLHAARPDVVMTQSPSSLSASVGDRVTITCMASEDIYIRLAWYQQKPGNAPKLLIYAATSLETGVPSRFSGSGSGTDFTLTISSLQPEDFATYYCQQYWSSPWTFGGGTKVEIKGGGGSGGGGSGGGGSQVQLQESGPGLVKPSQTLSLTCTVSGYSITSDYTWNWIRQPPGNGLEWIGYITYSGSTSYNPSLKSRVLISVDTSKNQVSLKLSSVTAADTAVYYCARLGRRYTMDYWGQGTTVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 7444 - protein, 423 aa, Artificial Sequence
  Synthetic Polypeptide encoding a CAR with optional accessory module(s)
MALPVTALLLPLALLLHAARPDVVMTQSPSSLSASVGDRVTITCMASEDIYIRLAWYQQKPGNAPKLLIYAATSLETGVPSRFSGSGSGTDFTLTISSLQPEDFATYYCQQYWSSPWTFGGGTKVEIKGGGGSGGGGSGGGGSQVQLQESGPGLVKPSQTLSLTCTVSGYSITSDYTWNWIRQPPGNGLEWIGYITYSGSTSYNPSLKSRVLISVDTSKNQVSLKLSSVTAADTAVYYCARLGRRYTMDYWGQGTTVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRN

SEQ ID NO: 7445 - protein, 629 aa, Artificial Sequence
  Synthetic Polypeptide encoding a CAR with optional accessory module(s)
MALPVTALLLPLALLLHAARPDVVMTQSPSSLSASVGDRVTITCMASEDIYIRLAWYQQKPGNAPKLLIYAATSLETGVPSRFSGSGSGTDFTLTISSLQPEDFATYYCQQYWSSPWTFGGGTKVEIKGGGGSGGGGSGGGGSQVQLQESGPGLVKPSQTLSLTCTVSGYSITSDYTWNWIRQPPGNGLEWIGYITYSGSTSYNPSLKSRVLISVDTSKNQVSLKLSSVTAADTAVYYCARLGRRYTMDYWGQGTTVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 7446 - protein, 406 aa, Artificial Sequence
  Synthetic Polypeptide encoding a CAR with optional accessory module(s)
MALPVTALLLPLALLLHAARPDVVMTQSPSSLSASVGDRVTITCMASEDIYIRLAWYQQKPGNAPKLLIYAATSLETGVPSRFSGSGSGTDFTLTISSLQPEDFATYYCQQYWSSPWTFGGGTKVEIKGGGGSGGGGSGGGGSQVQLQESGPGLVKPSQTLSLTCTVSGYSITSDYTWNWIRQPPGNGLEWIGYITYSGSTSYNPSLKSRVLISVDTSKNQVSLKLSSVTAADTAVYYCARLGRRYTMDYWGQGTTVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 7447 - protein, 875 aa, Artificial Sequence
  Synthetic Polypeptide encoding a CAR with optional accessory module(s)
MALPVTALLLPLALLLHAARPDVVMTQSPSSLSASVGDRVTITCMASEDIYIRLAWYQQKPGNAPKLLIYAATSLETGVPSRFSGSGSGTDFTLTISSLQPEDFATYYCQQYWSSPWTFGGGTKVEIKGGGGSGGGGSGGGGSQVQLQESGPGLVKPSQTLSLTCTVSGYSITSDYTWNWIRQPPGNGLEWIGYITYSGSTSYNPSLKSRVLISVDTSKNQVSLKLSSVTAADTAVYYCARLGRRYTMDYWGQGTTVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRIRAKRSGSGATNFSLLKQAGDVEENPGPSSMDWIWRILFLVGAATGAHSFEGGLEIQNPDPAVYQLRDSKSSDKSVCLFTDFDSQTNVSQSKDSDVYITDKTVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 7448 - protein, 914 aa, Artificial Sequence
  Synthetic Polypeptide encoding a CAR with optional accessory module(s)
MALPVTALLLPLALLLHAARPDVVMTQSPSSLSASVGDRVTITCMASEDIYIRLAWYQQKPGNAPKLLIYAATSLETGVPSRFSGSGSGTDFTLTISSLQPEDFATYYCQQYWSSPWTFGGGTKVEIKGGGGSGGGGSGGGGSQVQLQESGPGLVKPSQTLSLTCTVSGYSITSDYTWNWIRQPPGNGLEWIGYITYSGSTSYNPSLKSRVLISVDTSKNQVSLKLSSVTAADTAVYYCARLGRRYTMDYWGQGTTVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRIRAKRSGSGATNFSLLKQAGDVEENPGPSSMDWIWRILFLVGAATGAHSFEGGTREDLKNVFPPEVAVFEPSKAEIAHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGVKQTLNFDLLKLAGDVESNPGPSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 7449 - protein, 875 aa, Artificial Sequence
  Synthetic Polypeptide encoding a CAR with optional accessory module(s)
MALPVTALLLPLALLLHAARPDVVMTQSPSSLSASVGDRVTITCMASEDIYIRLAWYQQKPGNAPKLLIYAATSLETGVPSRFSGSGSGTDFTLTISSLQPEDFATYYCQQYWSSPWTFGGGTKVEIKGGGGSGGGGSGGGGSQVQLQESGPGLVKPSQTLSLTCTVSGYSITSDYTWNWIRQPPGNGLEWIGYITYSGSTSYNPSLKSRVLISVDTSKNQVSLKLSSVTAADTAVYYCARLGRRYTMDYWGQGTTVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRIRAKRSGSGATNFSLLKQAGDVEENPGPSSMDWIWRILFLVGAATGAHSFEGGLEIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 7450 - protein, 681 aa, Artificial Sequence
  Synthetic Polypeptide encoding a CAR with optional accessory module(s)
MALPVTALLLPLALLLHAARPDVVMTQSPSSLSASVGDRVTITCMASEDIYIRLAWYQQKPGNAPKLLIYAATSLETGVPSRFSGSGSGTDFTLTISSLQPEDFATYYCQQYWSSPWTFGGGTKVEIKGGGGSGGGGSGGGGSQVQLQESGPGLVKPSQTLSLTCTVSGYSITSDYTWNWIRQPPGNGLEWIGYITYSGSTSYNPSLKSRVLISVDTSKNQVSLKLSSVTAADTAVYYCARLGRRYTMDYWGQGTTVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRIRAKRSGSGATNFSLLKQAGDVEENPGPSSMDWIWRILFLVGAATGAHSFEGGTREDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 7451 - protein, 642 aa, Artificial Sequence
  Synthetic Polypeptide encoding a CAR with optional accessory module(s)
MALPVTALLLPLALLLHAARPDVVMTQSPSSLSASVGDRVTITCMASEDIYIRLAWYQQKPGNAPKLLIYAATSLETGVPSRFSGSGSGTDFTLTISSLQPEDFATYYCQQYWSSPWTFGGGTKVEIKGGGGSGGGGSGGGGSQVQLQESGPGLVKPSQTLSLTCTVSGYSITSDYTWNWIRQPPGNGLEWIGYITYSGSTSYNPSLKSRVLISVDTSKNQVSLKLSSVTAADTAVYYCARLGRRYTMDYWGQGTTVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRIRAKRSGSGATNFSLLKQAGDVEENPGPSSMDWIWRILFLVGAATGAHSFEGGLEIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 7452 - protein, 656 aa, Artificial Sequence
  Synthetic Polypeptide encoding a CAR with optional accessory module(s)
MALPVTALLLPLALLLHAARPDVVMTQSPSSLSASVGDRVTITCMASEDIYIRLAWYQQKPGNAPKLLIYAATSLETGVPSRFSGSGSGTDFTLTISSLQPEDFATYYCQQYWSSPWTFGGGTKVEIKGGGGSGGGGSGGGGSQVQLQESGPGLVKPSQTLSLTCTVSGYSITSDYTWNWIRQPPGNGLEWIGYITYSGSTSYNPSLKSRVLISVDTSKNQVSLKLSSVTAADTAVYYCARLGRRYTMDYWGQGTTVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNRAKRSGSGATNFSLLKQAGDVEENPGPSSMDWIWRILFLVGAATGAHSFEGGTREDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 7453 - protein, 617 aa, Artificial Sequence
  Synthetic Polypeptide encoding a CAR with optional accessory module(s)
MALPVTALLLPLALLLHAARPDVVMTQSPSSLSASVGDRVTITCMASEDIYIRLAWYQQKPGNAPKLLIYAATSLETGVPSRFSGSGSGTDFTLTISSLQPEDFATYYCQQYWSSPWTFGGGTKVEIKGGGGSGGGGSGGGGSQVQLQESGPGLVKPSQTLSLTCTVSGYSITSDYTWNWIRQPPGNGLEWIGYITYSGSTSYNPSLKSRVLISVDTSKNQVSLKLSSVTAADTAVYYCARLGRRYTMDYWGQGTTVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNRAKRSGSGATNFSLLKQAGDVEENPGPSSMDWIWRILFLVGAATGAHSFEGGLEIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 7454 - protein, 646 aa, Artificial Sequence
  Synthetic Polypeptide encoding a CAR with optional accessory module(s)
MALPVTALLLPLALLLHAARPDVVMTQSPSSLSASVGDRVTITCMASEDIYIRLAWYQQKPGNAPKLLIYAATSLETGVPSRFSGSGSGTDFTLTISSLQPEDFATYYCQQYWSSPWTFGGGTKVEIKGGGGSGGGGSGGGGSQVQLQESGPGLVKPSQTLSLTCTVSGYSITSDYTWNWIRQPPGNGLEWIGYITYSGSTSYNPSLKSRVLISVDTSKNQVSLKLSSVTAADTAVYYCARLGRRYTMDYWGQGTTVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKRAKRSGSGATNFSLLKQAGDVEENPGPSSMDWIWRILFLVGAATGAHSFEGGTREDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 7455 - protein, 607 aa, Artificial Sequence
  Synthetic Polypeptide encoding a CAR with optional accessory module(s)
MALPVTALLLPLALLLHAARPDVVMTQSPSSLSASVGDRVTITCMASEDIYIRLAWYQQKPGNAPKLLIYAATSLETGVPSRFSGSGSGTDFTLTISSLQPEDFATYYCQQYWSSPWTFGGGTKVEIKGGGGSGGGGSGGGGSQVQLQESGPGLVKPSQTLSLTCTVSGYSITSDYTWNWIRQPPGNGLEWIGYITYSGSTSYNPSLKSRVLISVDTSKNQVSLKLSSVTAADTAVYYCARLGRRYTMDYWGQGTTVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKRAKRSGSGATNFSLLKQAGDVEENPGPSSMDWIWRILFLVGAATGAHSFEGGLEIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 7456 - protein, 639 aa, Artificial Sequence
  Synthetic Polypeptide encoding a CAR with optional accessory module(s)
MALPVTALLLPLALLLHAARPDVVMTQSPSSLSASVGDRVTITCMASEDIYIRLAWYQQKPGNAPKLLIYAATSLETGVPSRFSGSGSGTDFTLTISSLQPEDFATYYCQQYWSSPWTFGGGTKVEIKGGGGSGGGGSGGGGSQVQLQESGPGLVKPSQTLSLTCTVSGYSITSDYTWNWIRQPPGNGLEWIGYITYSGSTSYNPSLKSRVLISVDTSKNQVSLKLSSVTAADTAVYYCARLGRRYTMDYWGQGTTVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRRAKRSGSGATNFSLLKQAGDVEENPGPSSMDWIWRILFLVGAATGAHSFEGGTREDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 7457 - protein, 600 aa, Artificial Sequence
  Synthetic Polypeptide encoding a CAR with optional accessory module(s)
MALPVTALLLPLALLLHAARPDVVMTQSPSSLSASVGDRVTITCMASEDIYIRLAWYQQKPGNAPKLLIYAATSLETGVPSRFSGSGSGTDFTLTISSLQPEDFATYYCQQYWSSPWTFGGGTKVEIKGGGGSGGGGSGGGGSQVQLQESGPGLVKPSQTLSLTCTVSGYSITSDYTWNWIRQPPGNGLEWIGYITYSGSTSYNPSLKSRVLISVDTSKNQVSLKLSSVTAADTAVYYCARLGRRYTMDYWGQGTTVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRRAKRSGSGATNFSLLKQAGDVEENPGPSSMDWIWRILFLVGAATGAHSFEGGLEIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 7458 - protein, 572 aa, Artificial Sequence
  Synthetic Polypeptide encoding a Bispecific T cell engager antibody
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSRVTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7459 - protein, 572 aa, Artificial Sequence
  Synthetic Polypeptide encoding a Bispecific T cell engager antibody
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7460 - protein, 572 aa, Artificial Sequence
  Synthetic Polypeptide encoding a Bispecific T cell engager antibody
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7461 - protein, 573 aa, Artificial Sequence
  Synthetic Polypeptide encoding a Bispecific T cell engager antibody
MALPVTALLLPLALLLHAARPDEIVLTQSPATLSLSPGERATLSCSASSSVSYMHWYQQKPGQAPRLLIYDTSKLASGIPARFSGSGSGTDFTLTISSLEPEDVAVYYCFQGSVYPFTFGQGTKLEIKRGGGGSGGGGSGGGGSQVQLQESGPGLVKPSQTLSLTCTVSGGSISTSGMGVGWIRQHPGKGLEWIGHIWWDDDKRYNPALKSRVTISVDTSKNQFSLKLSSVTAADTAVYYCARMELWSYYFDYWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7462 - protein, 580 aa, Artificial Sequence
  Synthetic Polypeptide encoding a Bispecific T cell engager antibody
MALPVTALLLPLALLLHAARPDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7463 - protein, 579 aa, Artificial Sequence
  Synthetic Polypeptide encoding a Bispecific T cell engager antibody
MALPVTALLLPLALLLHAARPDIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKRGGGGSGGGGSGGGGSEVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7464 - protein, 577 aa, Artificial Sequence
  Synthetic Polypeptide encoding a Bispecific T cell engager antibody
MALPVTALLLPLALLLHAARPEIVLTQSPDFQSVTPKEKVTITCRASESVDTFGISFMNWFQQKPDQSPKLLIHAASNQGSGVPSRFSGSGSGTDFTLTINSLEAEDAATYYCQQSKEVPFTFGGGTKVEIKGGGGSGGGGSGGGGSEVQLVESGGGLVQPGGSLRLSCAASGFTFSSSWMNWVRQAPGKGLEWVGRIYPGDGDTNYNGKFKGRFTISRDDSKNSLYLQMNSLKTEDTAVYYCARSGFITTVLDFDYWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7465 - protein, 573 aa, Artificial Sequence
  Synthetic Polypeptide encoding a Bispecific T cell engager antibody
MALPVTALLLPLALLLHAARPAIQLTQSPSSLSASVGDRVTITCRASQGISSAQQKPGKAPKLLILAWYSSLESGVPSRFSGYDASGSGTDFTLTISSLQPEDFATYYCQQFNSYPYTFGQGTKLEIKGGGGSGGGGSGGGGSEVQLVQSGAEVKKPGESLKISCKGSGYSFSSSWIGWVRQMPGKGLEWMGIIYPDDSDTRYSPSFQGQVTISADKSIRTAYLQWSSLKASDTAMYYCARHVTMIWGVIIDFWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7466 - protein, 597 aa, Artificial Sequence
  Synthetic Polypeptide encoding a Bispecific T cell engager antibody
MALPVTALLLPLALLLHAARPINIYNAEPANPSEKNSPEFDIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKGGGGSGGGGSGGGGSEVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7467 - protein, 579 aa, Artificial Sequence
  Synthetic Polypeptide encoding a Bispecific T cell engager antibody
MALPVTALLLPLALLLHAARPDILLTQSPATLSLSPGERATLSCRASQSVDYDGDSYLNWYQQKPGQPPKLLIYDASNLVSGIPPRFSGSGSGTDFTLTISRLEPEDFAVYHCQQSTEDPWTFGGGTKLEIKGGGGSGGGGSGGGGSQVQLVESGGGLVEPGGSLRLSCMSGYAFSSYWMNWVRQMPGKGLEWMGQIWPGDGDTNYNPSLKSRVTITADESTSTAYMELSSLKAEDTAVYFCARRETTTVGRYYYAMDYWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7468 - protein, 576 aa, Artificial Sequence
  Synthetic Polypeptide encoding a Bispecific T cell engager antibody
MALPVTALLLPLALLLHAARPDILLTQSPATLSLSPGERATLSCRASQSVDNYGISFMNWYQQKPGQPPKLLIYAASNQGSGIPSRFSGSGSGTDFTLTISSLEPEDFAMYFCQQSNEVPRTFGGGTKLEIKGGGGSGGGGSGGGGSQVQLVESGGGLVEPGGSLRLSCMSGYAFSSSWMNWVRQMPGKGLEWMGRIYPGDGDTNYNGKFKERVTITADESTSTAYMELSSLKAEDTAVYFCARSEYWGNYWAMDYWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7469 - protein, 575 aa, Artificial Sequence
  Synthetic Polypeptide encoding a Bispecific T cell engager antibody
MALPVTALLLPLALLLHAARPDILLTQSPATLSLSPGERATLSCKASQNVGTNVAWYQQKPGQPPKLLIYSATYRNSGIPARFSGSGSGTEFTLTITNVQSKDLADYFYFCQYNRYPYTSGGGTKLEIKRGGGGSGGGGSGGGGSQVQLVESGGGLVEPGGSLRLSCMSGYAFSSYWMNWVRQMPGKGLEWMGQIYPGDGDTNYNGKFKGRVTITADESTSTAYMELSSLKAEDTAVYFCARKTISSVVDFYFDNWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7470 - protein, 588 aa, Artificial Sequence
  Synthetic Polypeptide encoding a Bispecific T cell engager antibody
MALPVTALLLPLALLLHAARPINIYNAEPANPSEKNSPEFQIVLTQSPATLSASPGEKATMTCSASSGVNYMHWYQQKPGTSPKRWIYDTDKTASGVPARFSGSGSGTSYSLTISSMEAEDAATYYCHQRGSYTFGGGTKLEIKGGGGSGGGGSGGGGSQVQLEQPGAEVVKPGASVKVSCKTSGYTFTSNWMHWVKQTPGKGLEWIGEIDPSDSYTNYNQKFDGKAKLTVDKSSSTAYMEVSDLTAEDSATYYCARGSNPYYYAMDYWGQGTSVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7471 - protein, 574 aa, Artificial Sequence
  Synthetic Polypeptide encoding a Bispecific T cell engager antibody
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRGGGGSGGGGSGGGGSQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7472 - protein, 582 aa, Artificial Sequence
  Synthetic Polypeptide encoding a Bispecific T cell engager antibody
MALPVTALLLPLALLLHAARPDDIQLTQSPSSLSASVGDRVTITCKASQSVDYDGDSYLNWYQQIPGKAPKLLIYDASNLVSGIPPRFSGSGSGTDYTFTISSLQPEDIATYHCQQSTEDPWTFGGGTKLQIKRGGGGSGGGGSGGGGSQVQLQQSGAEVKKPGSSVKVSCKASGYAFSSYWMNWVRQRPGQGLEWIGQIWPGDGDTNYNGKFKGRATITADESTNTAYMELSSLRSEDTAFYSCARRETTTVGRYYYAMDYWGQGTTVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7473 - protein, 573 aa, Artificial Sequence
  Synthetic Polypeptide encoding a Bispecific T cell engager antibody
MALPVTALLLPLALLLHAARPQSVLTQPASVSGSPGQSITISCTGTSSDVGGYNYVSWYQQHPGKAPKLMIYDVNNRPSEVSNRFSGSKSGNTASLTISGLQAEDEADYYCSSYTTGSRAVFGGGTKLTVLGGGGGSGGGGSGGGGSEVQLVQSGAEVKKPGESLTISCKASGYSFPNYWITWVRQMSGGGLEWMGRIDPGDSYTTYNPSFQGHVTISIDKSTNTAYLHWNSLKASDTAMYYCARYYVSLVDIWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7474 - protein, 579 aa, Artificial Sequence
  Synthetic Polypeptide encoding a Bispecific T cell engager antibody
MALPVTALLLPLALLLHAARPQSVVTQPPSVSAAPGQKVTISCSGSSSNIGNNYVSWYQQLPGTAPKLLIYDNNKRPSGIPDRFSGSKSGTSATLGITGLQTGDEADYYCGTWDGSLYTMLFGGGTKLTVLGGGGSGGGGSGGGGSEVQLVESGGGLVKPGGSLRLSCAASGFTFSNAWMSWVRQAPGKGLEWVGFIRSKAYGGTTEYAASVKGRFTISRDDSKSIAYLQMNNLKTEDTAVYYCARDGLYSSSWYDSDYWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7475 - protein, 584 aa, Artificial Sequence
  Synthetic Polypeptide encoding a Bispecific T cell engager antibody
MALPVTALLLPLALLLHAARPQSVLTQPPSVSGAPGQRVTISCTGSSSNIGAGYDVHWYQQLPGTAPKLLIFGNSNRPSGVPDRFSGFKSGTSASLAITGLQAEDEADYFCQSYDSSLSGSGVFGTGTKVTVLGGGGGSGGGGSGGGGSQMQLVQSGGGLVQPGRSLRLSCAASGFTFDDYAMHWVRQAPGKGLEWVSGISWNSGSIGYADSVKGRFTISRDNAKNSLYLQMNSLRAEDTALYYCAKDIHSGSYYGLLYYAMDVWGQGTTVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7476 - protein, 571 aa, Artificial Sequence
  Synthetic Polypeptide encoding a Bispecific T cell engager antibody
MALPVTALLLPLALLLHAARPDYIHVTQSPSSLSVSIGDRVTINCQTSQGVGSDLHWYQHKPGRAPKLLIHHASSVEDGVPSRFSGTGFHTSFNLTINDLQADDIGTYYCQVLQSFGRGSRLDTKGGGGSGGGGSGGGGSRAHLVQSGTAMKKPGASVRVSCQTSGYTFTAHILFWFRQAPGRGLEWVGWIKPQYGAVNFGGGFRDRVTLTRDVYREIAYMDIRGLKPDDTAVYYCARDRSYGDSSWALDAWGQGTTVVVSATRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7477 - protein, 581 aa, Artificial Sequence
  Synthetic Polypeptide encoding a Bispecific T cell engager antibody
MALPVTALLLPLALLLHAARPDVQMIQTPDSLAVSLGQRATISCRASESVDNYGISFMHWYQQKPGQSPKLLIYRASNLESGIPARFSGSGSRTDFTLTINPVETDDVATYYCQQNNKDPPTFGGGTKLEIKGGGGSGGGGSGGGGSGGGGSQVQLQQSGAELVKPGASVKISCKASGYAFSSYWMNWVKQRPGKGLEWIGQIYPGDGDTTYNGKFKGKATLTADKSSSTVYMQLNSLTSEDSAVYFCVRYYYGSSGYFDYWGQGTTLTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7478 - protein, 572 aa, Artificial Sequence
  Synthetic Polypeptide encoding a Bispecific T cell engager antibody
MALPVTALLLPLALLLHAARPDVQMIQTPSSLSASLGDRVTISCRASQDIGNYLNWYQQKPDGTVKLLIYYTSRLHSGVPSRFSGSGSGTEYSLTISNLEQEDIATYFCQQGSALPPTFGGGTKLEINGGGGSGGGGSGGGGSALQLQQSGAELVRPGASVTLSCKASGYTFTDYEMHWVKQTPVHGLEWIGAIDPETGGTAYNQKFEGKAILTADKSSSTAYMELRSLTSEDSPVYYCARRRYYGSSSFDYWGQGTTLTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7479 - protein, 579 aa, Artificial Sequence
  Synthetic Polypeptide encoding a Bispecific T cell engager antibody
MRLPAQLLGLLMLWVSGSSGDVVMTQSPLSLPVTPGAPASISCRSSQSIVHSNGNTYLEWYLQKPGQSPKLLIYKVSNRFSGVPDRFSGSGSGTDFTLRISRVEAEDVGIYYCFQGSHVPPTFGPGTKLEIKGGGGSGGGGSGGGGSEVQLVESGGGLVQPGGSLRLSCSASGFTFSSFGMHWVRQAPGKGLEWVAYISSGSSTIYYGDTVKGRFTISRDNAKNSLFLQMSSLRAEDTAVYYCAREGGYYYGRSYYTMDYWGQGTTVTVSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7480 - protein, 604 aa, Artificial Sequence
  Synthetic Polypeptide encoding a Bispecific T cell engager antibody
MALPVTALLLPLALLLHAARPARKRTQPTFGFTVNWKFSESTTVFTGQCFIDRNGKEVLKTMWLLRSSVNDIGDDWKATRVGINIFTRLRTQKEGGSGGSARKCSLTGKWTNDLGSNMTIGAVNSRGEFTGTYITAVTATSNEIKESPLHGTQNTINKSGGSTTVFTGQCFIDRNGKEVLKTMWLLRSSVNDIGDDWKATRVGINIFTRLRTQKEGGSGGSARKCSLTGKWTNDLGSNMTIGAVNSRGEFTGTYITAVTATSNEIKESPLHGTQNTINKRTQPTFGFTVNWKFSETRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7481 - protein, 576 aa, Artificial Sequence
  Synthetic Polypeptide encoding a Bispecific T cell engager antibody
MALPVTALLLPLALLLHAARPDIVLTQSPASLAVSLGQRATISCRASKSVSTSGYSYLHWYQQKPGQPPKLLIYLASNLESGVPARFSGSGSGTDFTLNIHPVEEEDAATYYCQHSRELPFTFGSGTKLEIKGGGGSGGGGSGGGGSQVQLVESGGGLVQPGGSLKLSCAASGFDFSRYWMSWVRQAPGKGLEWIGEINPTSSTINFTPSLKDKVFISRDNAKNTLYLQMSKVRSEDTALYYCARGNYYRYGDAMDYWGQGTSVTVSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7482 - protein, 574 aa, Artificial Sequence
  Synthetic Polypeptide encoding a Bispecific T cell engager antibody
MALPVTALLLPLALLLHAARPDIQMTQSPSSLSASVGDRVTITCSASQDISNYLNWYQQKPGKAPKLLIYYTSNLHSGVPSRFSGSGSGTDFTLTISSLQPEDFATYYCQQYRKLPWTFGQGTKLEIKRGGGGSGGGGSGGGGSQVQLVQSGAEVKKPGSSVKVSCKASGGTFSNYWMHWVRQAPGQGLEWMGATYRGHSDTYYNQKFKGRVTITADKSTSTAYMELSSLRSEDTAVYYCARGAIYDGYDVLDNWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7483 - protein, 574 aa, Artificial Sequence
  Synthetic Polypeptide encoding a Bispecific T cell engager antibody
MALPVTALLLPLALLLHAARPDIVLTQSPATLSLSPGDRATISCRASESVTILGSHLIYWYQQKPGQPPRLLIQLASNVQTGVPARFSGSGSRTDFTLTISSVEPEDFAVYYCLQSRTIPRTFGQGTKLEIKRGGGGSGGGGSGGGGSQVQLVQSGPEVKKPGESVKISCKASGYTFRHYSMNWVKQAPGQGLKWMGRINTESGVPIYADDFKGRFSFTVDTSASTAYLEISSLTSEDTAVYFCSNDYLYSLDFWGQGTTLTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7484 - protein, 575 aa, Artificial Sequence
  Synthetic Polypeptide encoding a Bispecific T cell engager antibody
MALPVTALLLPLALLLHAARPQSVLTQPPSVSGAPGQRVTISCTGSSSNIGAGFDVHWYQQLPGTAPKLLIYGNSNRPSGVPDRFSGSKSGTSASLAITGLQAEDEADYYCQSYDSSLSGYVFGTGTKVTVLGGGGGSGGGGSGGGGSQVQLVQSGAEVKKPGASVKVSCKASGYTFTDYYMHWVRQAPGQRLEWMGWINPNSGGTNYAQKFQDRITVTRDTSSNTGYMELTRLRSDDTAVYYCARSPYSGVLDKWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7485 - protein, 573 aa, Artificial Sequence
  Synthetic Polypeptide encoding a Bispecific T cell engager antibody
MALPVTALLLPLALLLHAARPQAVLTQPPSASGTPGQRVTISCSGSSSNIGSYTVSWYQQLPGTAPKFLIYSNNQRPSGVPDRFSGSKSGTSASLAISGLQSEDEADYYCAAWDDSLNGYVFGTGTKVTVLGGGGGSGGGGSGGGGSEVQLVQSGAEVKKPGESLKISCKGSGYDFTTYWIGWVRQMPGKGLEWMGIIYPGDSDTRYSPSVRGRVTISADKSINTAYLQWSSLEASDTAMYYCARMWTFSQDGWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7486 - protein, 584 aa, Artificial Sequence
  Synthetic Polypeptide encoding a Bispecific T cell engager antibody
MALPVTALLLPLALLLHAARPLPVLTQPPSASGTPGQRVTISCSGRSSNIGSNSVNWYRQLPGAAPKLLIYSNNQRPPGVPVRFSGSKSGTSASLAISGLQSEDEATYYCATWDDNLNVHYVFGTGTKVTVLGSRGGGGSGGGGSGGGGSLEMAQVQLVQSGAEVKKPGSSVKVSCKASGGTFSSYAISWVRQAPGQGLEWMGRIIPILGIANYAQKFQGRVTITADKSTSTAYMELSSLRSEDTAVYYCARGGYYSHDMWSEDWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7487 - protein, 573 aa, Artificial Sequence
  Synthetic Polypeptide encoding a Bispecific T cell engager antibody
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKGGGGSGGGGSGGGGSQVQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7488 - protein, 574 aa, Artificial Sequence
  Synthetic Polypeptide encoding a Bispecific T cell engager antibody
MALPVTALLLPLALLLHAARPDIVLTQSPATLSLSPGDRATLSCRASESVTILGSHLIYWYQQKPGQAPRLLIQLASNVQTGIPARFSGSGSRTDFTLTISSLEPEDFAVYYCLQSRTIPRTFGQGTKLEIKRGGGGSGGGGSGGGGSQVQLVQSGSELKKPGESVKISCKASGYTFTHYSMNWVRQAPGQGLEWMGRINTETGEPLYADDFKGRFVFSLDTSASTAYLQISSLKAEDTAVYYCSNDYLYSLDYWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7489 - protein, 575 aa, Artificial Sequence
  Synthetic Polypeptide encoding a Bispecific T cell engager antibody
MALPVTALLLPLALLLHAARPDIVMTQSPDSLAVSLGERATINCKSSQSILYSSNQKNYLAWYQQKPGQSPKLLIYWASTRESGVPDRFSGSGSGTDFTLTISSLQAEDVAVYYCHQYISSYTFGQGTKLEIKGGGGSGGGGSGGGGSQVQLVQSGAEVKKPGASVKVSCKASGYTFASQWMHWMRQAPGQGLEWIGWINPGNVNTKYNEKFKGRATLTVDTSTNTAYMELSSLRSEDTAVYYCARSTWYRPLDYWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7490 - protein, 699 aa, Artificial Sequence
  Synthetic Polypeptide encoding a Bispecific T cell engager antibody
MVRGVPFRHLLLVLQLALLPAATQGKKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASGGGGSGGGGSGGGGSIYQELTQLKAAVERLCHPCPWEWTFFQGNCYFMSNSQRNWHDSITACKEVGAQLVVIKSAEEQNFLQLQSSRSNRFTWMGLSDLNQEGTWQWVDGSPLLPSFKQYWNRGEPNNVGEEDCAEFSGNGWNDDKCNLAKFWICKKSAASCSRDEEQFLSPAPATPNPPPATRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7491 - protein, 575 aa, Artificial Sequence
  Synthetic Polypeptide encoding a Bispecific T cell engager antibody
MALPVTALLLPLALLLHAARPDHIVLTQSPSSLSASLGDRVTISCRASQDISTYLNWYQQKPDGTVKLLIFYTSRLHAGVPSRFSGSGSGTHHSLTISNLEQEDIATYFCQQGNSLPFTFGSGTKLEIKRGGGGSGGGGSGGGGSQVQLKESGPELEKPGASVKISCKASGYSFTAYSMNWVKQNNGMSLEWIGSIDPYYGDTKYAQKFKGKATLTVDKASSTAYLQLKSLTSEDSAVYYCARRMITTGDWYFDVWGAGTTVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7492 - protein, 575 aa, Artificial Sequence; identical to SEQ ID NO: 7491
  Synthetic Polypeptide encoding a Bispecific T cell engager antibody

SEQ ID NO: 7493 - protein, 522 aa, Artificial Sequence
  Synthetic Polypeptide encoding a Bispecific T cell engager antibody
MALPVTALLLPLALLLHAARPGMRTEDLPKAVVFLEPQWYRVLEKDSVTLKCQGAYSPEDNSTQWFHNESLISSQASSYFIDAATVDDSGEYRCQTNLSTLSDPVQLEVHIGWLLLQAPRWVFKEEDPIHLRCHSWKNTALHKVTYLQNGKGRKYFHHNSDFYIPKATLKDSGSYFCRGLVGSKNVSSETVNITITQGLAVSTISSFFPPGYQTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7494 - protein, 522 aa, Artificial Sequence; identical to SEQ ID NO: 7493
  Synthetic Polypeptide encoding a Bispecific T cell engager antibody

SEQ ID NO: 7495 - protein, 575 aa, Artificial Sequence
  Synthetic Polypeptide encoding a Bispecific T cell engager antibody
MALPVTALLLPLALLLHAARPDEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGGGGSGGGGSGGGGSEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7496 - protein, 577 aa, Artificial Sequence
  Synthetic Polypeptide encoding a Bispecific T cell engager antibody
MALPVTALLLPLALLLHAARPDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKRGGGGSGGGGSGGGGSQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7497 - protein, 574 aa, Artificial Sequence
  Synthetic Polypeptide encoding a Bispecific T cell engager antibody
MALPVTALLLPLALLLHAARPDIVLTQSPAIITASPGEKVTMTCRASSSVNYMDWYQKKPGSSPKPWIYATSNLASGVPSRFSGSGSGTTYSMTISSLEAEDAATYYCQQWSFNPPTFGGGTKLEIKRGGGGSGGGGSGGGGSEVQLQQSGAELKKPGASVKVSCKASGYTFTSYNMHWVKQTPGQGLEWIGAIYPGNGDTSYNQKFKGKTTLTADKSSSTAYMELSSLRSEDTAVYYCARSNYYGSSYWFFDVWGTGTTVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7498 - protein, 577 aa, Artificial Sequence
  Synthetic Polypeptide encoding a Bispecific T cell engager antibody
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSDWPLTFGGGTKVEIKGGGGSGGGGSGGGGSEVQLVQSGGGLVHPGGSLRLSCTGSGFTFSYHAMHWVRQAPGKGLEWVSIIGTGGVTYYADSVKGRFTISRDNVKNSLYLQMNSLRAEDMAVYYCARDYYGAGSFYDGLYGMDVWGQGTTVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7499 - protein, 575 aa, Artificial Sequence
  Synthetic Polypeptide encoding a Bispecific T cell engager antibody
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGGGTKVEIKGGGGSGGGGSGGGGSAVQLVESGGGLVQPGRSLRLSCAASGFTFGDYTMHWVRQAPGKGLEWVSGISWNSGSIGYADSVKGRFTISRDNAKNSLYLQMNSLRAEDTALYYCTKDNQYGSGSTYGLGVWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7500 - protein, 574 aa, Artificial Sequence
  Synthetic Polypeptide encoding a Bispecific T cell engager antibody
MALPVTALLLPLALLLHAARPDIQMTQSPSSLSASVGDRVTITCRASSSVSYMHWYQQKPGKAPKPLIYAPSNLASGVPSRFSGSGSGTDFTLTISSLQPEDFATYYCQQWSFNPPTFGQGTKVEIKRGGGGSGGGGSGGGGSEVQLVESGGGLVQPGGSLRLSCAASGYTFTSYNMHWVRQAPGKGLEWVGAIYPGNGDTSYNQKFKGRFTISVDKSKNTLYLQMNSLRAEDTAVYYCARVVYYSNSYWYFDVWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7501 - protein, 572 aa, Artificial Sequence
  Synthetic Polypeptide encoding a Bispecific T cell engager antibody
MALPVTALLLPLALLLHAARPDIQLTQSPSSLSASVGDRVTMTCRASSSVSYIHWFQQKPGKAPKPWIYATSNLASGVPVRFSGSGSGTDYTFTISSLQPEDIATYYCQQWTSNPPTFGGGTKLEIKGGGGSGGGGSGGGGSQVQLQQSGAEVKKPGSSVKVSCKASGYTFTSYNMHWVKQAPGQGLEWIGAIYPGNGDTSYNQKFKGKATLTADESTNTAYMELSSLRSEDTAFYYCARSTYYGGDWYFDVWGQGTTVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7502 - protein, 584 aa, Artificial Sequence
  Synthetic Polypeptide encoding a Bispecific T cell engager antibody
MALPVTALLLPLALLLHAARPSTVMTQSPDSLAVSLGERATINCKSSQSNSNDVAWYQQKPGQSPKVLIYFASNRYSGVPDRFSGSGYGTDFTLTISSLQAEDVAVYFCQQDYSSPLTFGAGTKLELKRADAGGGGSGGGGSGGGGSQIQLVQSGSELKKPGASVKVSCKASGYTFTNFGVNWVRQAPGKGLEWMGWINTYTGEPSYAQGFTGRFVFSLDASVSTAYLQISSLKAEDTATYFCTRRTNYYGTSYYYAMDYWGQGTTVTVSSAKTTTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7503 - protein, 576 aa, Artificial Sequence
  Synthetic Polypeptide encoding a Bispecific T cell engager antibody
MALPVTALLLPLALLLHAARPQIVLSQSPAILSASPGEKVTMTCRASSSVSYMHWYQQKPGSSPKPWIYATSNLASGVPARFSGSGSGTSYSFTISRVEAEDAATYYCQQWTFNPPTFGGGTRLEIKRTVAAGGGGSGGGGSGGGGSQAYLQQSGAELVRPGASVKMSCKASGYTFTSYNMHWVKQTPRQGLEWIGGIYPGNGDTSYNQKFKGKATLTVGKSSSTAYMQLSSLTSEDSAVYFCARYDYNYAMDYWGQGTSVTVSSASTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7504 - protein, 574 aa, Artificial Sequence; identical to SEQ ID NO: 7500
  Synthetic Polypeptide encoding a Bispecific T cell engager antibody

SEQ ID NO: 7505 - protein, 573 aa, Artificial Sequence
  Synthetic Polypeptide encoding a Bispecific T cell engager antibody
MALPVTALLLPLALLLHAARPEIVLTQSPSSLSASVGDRVTITCRASSSLSFMHWYQQKPGKAPKPWIYATSNLASGVPSRFSGSGSGTDYTLTISSLQPEDFATYFCHQWSSNPLTFGGGTKVEIKGGGGSGGGGSGGGGSQVQLVQSGAEVKKPGASVKVSCKASGYTFTSYNMHWVRQAPGQRLEWIGAIYPGNGDTSYNQKFKGRVTVTRDTSANTAYMELSSLKSEDTAVYYCARSHYGSNYVDYFDYWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7506 - protein, 575 aa, Artificial Sequence
  Synthetic Polypeptide encoding a Bispecific T cell engager antibody
MALPVTALLLPLALLLHAARPDEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGGGGSGGGGSGGGGSEVQLVESGGGLVQPDRSLRLSCAASGFTFHDYAMHWVRQAPGKGLEWVSTISWNSGTIGYADSVKGRFTISRDNAKNSLYLQMNSLRAEDTALYYCAKDIQYGNYYYGMDVWGQGTTVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7507 - protein, 573 aa, Artificial Sequence
  Synthetic Polypeptide encoding a Bispecific T cell engager antibody
MALPVTALLLPLALLLHAARPEIVLTQSPGTLSLSPGERATLSCRASSSVPYIHWYQQKPGQAPRLLIYATSALASGIPDRFSGSGSGTDFTLTISRLEPEDFAVYYCQQWLSNPPTFGQGTKLELKRGGGGSGGGGSGGGGSEVQLVQSGAEVKKPGESLKLSCKGSGRTFTSYNMHWVRQMPGKGLEWMGAIYPLTGDTSYNQKSKLQVTISADKSISTAYLQWSSLKASDTAMYYCARSTYVGGDWQFDVWGKGTTVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7508 - protein, 578 aa, Artificial Sequence
  Synthetic Polypeptide encoding a Bispecific T cell engager antibody
MALPVTALLLPLALLLHAARPDIQMTQSPSSLSASVGDRVTITCRSSQSIVHSVGNTFLEWYQQKPGKAPKLLIYKVSNRFSGVPSRFSGSGSGTDFTLTISSLQPEDFATYYCFQGSQFPYTFGQGTKVEIKRGGGGSGGGGSGGGGSEVQLVESGGGLVQPGGSLRLSCAASGYEFSRSWMNWVRQAPGKGLEWVGRIYPGDGDTNYSGKFKGRFTISADTSKNTAYLQMNSLRAEDTAVYYCARDGSSWDWYFDVWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7509 - protein, 570 aa, Artificial Sequence
  Synthetic Polypeptide encoding a Bispecific T cell engager antibody
MALPVTALLLPLALLLHAARPDIVMTQSPSSLSASVGDRVTITCKASQSVTNDVAWYQQKPGKAPKLLIYYASNRYTGVPSRFSGSGSGTDFTLTISSLQPEDFATYYCQQDYRSPWTFGGGTKVEIKRGGGGSGGGGSGGGGSQVQLEESGGGVVRPGRSLRLSCAASGFTFSDYGVNWIRQAPGKGLEWVTIIWGDGRTDYNSALKSRFTVSRNNSNNTLSLQMNSLTTEDTAVYYCVRAPGNRAMEYWGQGVLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7510 - protein, 576 aa, Artificial Sequence
  Synthetic Polypeptide encoding a Bispecific T cell engager antibody
MALPVTALLLPLALLLHAARPDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQIFGQGTKLEIKGGGGSGGGGSGGGGSQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7511 - protein, 576 aa, Artificial Sequence
  Synthetic Polypeptide encoding a Bispecific T cell engager antibody
MALPVTALLLPLALLLHAARPQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSGGGGSGGGGSGGGGSDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQIFGQGTKLEIKTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7512 - protein, 569 aa, Artificial Sequence
  Synthetic Polypeptide encoding a Bispecific T cell engager antibody
MALPVTALLLPLALLLHAARPDIQMTQSPATIENTSLSASVGDRVTITCRASQGISSWLTWYQQKPEKAPKSLIYAASSLQSGVPSRFSGSGSGTDFTLTISSLQPEDFATYYCQQYDSYPITFGQGTRLEIKGGGGSGGGGSGGGGSQVQLQQWGAGLLKPSETLSLTCAVYGGSFSAYYWSWIRQPPGKGLEWIGDINHGGGTNYNPSLKSRVTISVDTSKNQFSLKLNSVTAADTAVYYCASLTAYWGQGSLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7513 - protein, 574 aa, Artificial Sequence
  Synthetic Polypeptide encoding a Bispecific T cell engager antibody
MALPVTALLLPLALLLHAARPDEIVLTQSPDSLAVSLGERATINCKASQSVDFDGDSYLNWYQQKPGQPPKVLIYAASTLQSGVPSRFSGSGSGTDFTLTINSLEAEDAATYYCQQSNEDPWTFGGGTKVEIKGGGGSGGGGSGGGGSQVQLVQSGAEVKKPGASVKVSCKVSGYTFTDYYITWVRQAPGQALEWMGWIYPGSGNTKYSQKFQGRFVFSVDTSASTAYLQLSSLKAEDTAVYYCANYGNYWFAYWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7514 - protein, 571 aa, Artificial Sequence
  Synthetic Polypeptide encoding a Bispecific T cell engager antibody
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKGGGGSGGGGSGGGGSEVQLVQSGGGLVHPGGSLRLSCAGSGFAFSSSTMHWIRQAPGKGLEWISLIGSGGGIYYGDSVKGRFTISRDNAKNSLYLQMNSLRAEDMAVYYCVRGYFDWVDYFDYWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7515 - protein, 581 aa, Artificial Sequence
  Synthetic Polypeptide encoding a Bispecific T cell engager antibody
MALPVTALLLPLALLLHAARPDDIVMTQSPDSLTVSLGERTTINCKSSQSVLDSSKNKNSLAWYQQKPGQPPKLLLSWASTRESGIPDRFSGSGSGTDFTLTIDSLQPEDSATYYCQQSAHFPITFGQGTRLEIKGGGGSGGGGSGGGGSQVQLVQSGAEVKKPGASVKVSCKASGYTFTNYGMNWVKQAPGQGLKWMGWINTYTGEPTYADDFKGRVTMTSDTSTSTAYLELHNLRSDDTAVYYCARWSWSDGYYVYFDYWGQGTTVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7516 - protein, 577 aa, Artificial Sequence
  Synthetic Polypeptide encoding a Bispecific T cell engager antibody
MALPVTALLLPLALLLHAARPDEIVLTQSPGSLAVSPGERVTMSCKSSQSVFFSSSQKNYLAWYQQIPGQSPRLLIYWASTRESGVPDRFTGSGSGTDFTLTISSVQPEDLAIYYCHQYLSSRTFGQGTKLEIKRGGGGSGGGGSGGGGSQVQLQQPGAEVVKPGASVKMSCKASGYTFTSYYIHWIKQTPGQGLEWVGVIYPGNDDISYNQKFQGKATLTADKSSTTAYMQLSSLTSEDSAVYYCAREVRLRYFDVWGQGTTVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7517 - protein, 603 aa, Artificial Sequence
  Synthetic Polypeptide encoding a Bispecific T cell engager antibody
MALPVTALLLPLALLLHAARPYINIYNAEPANPSEKNSPTQYAYGSGEFDIQLTQSPSSLSASVGDRVTITCRASQGISSVLAWYQQKPGKAPKLLIYDASSLESGVPSRFSGSGSGTDFTLTISSLQPEDFATYYCQQFNSSITFGQGTKLEIKRTVAAGGGGSGGGGSGGGGSQVQLVQSGAEVKKPGSSVKVSCKASGGTFSDYAISWVRQAPGQGLEWMGRIIPILGVANYAQKFQGRVTITADKSTRTAYMELSSLRSEDTAVYYCARNWADAFDIWGQGTMVTVSSASTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7518 - protein, 602 aa, Artificial Sequence
  Synthetic Polypeptide encoding a Bispecific T cell engager antibody
MALPVTALLLPLALLLHAARPYINIYNAEPANPSEKNSPTQYAYGSGEFDIVMTQSPSSLSASLGGKVTITCKASQDINKYIAWYQHKPGKGPRLLIHYTSTLQPGIPSRFSGSGSGRDYSFSISNLEPEDIATYYCLQYDNLLTFGAGTKLELKRGGGGSGGGGSGGGGSEVKLQQSGPELVKPGTSVKVSCKASGYSFTDYNMYWVKQSHGKSLEWIGYIDPYKGGTIYNQKFKGKATLTVDKSSSTAFMHLNSLTSEDSAVYYCAREMITAYYFDYWGQGSSVTVSSLERTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7519 - protein, 618 aa, Artificial Sequence
  Synthetic Polypeptide encoding a Bispecific T cell engager antibody
MALPVTALLLPLALLLHAARPDIQMTQSPSSLSASVGDRVTINCKASQDINSYLSWFQQKPGKAPKTLIYRANRLVDGVPSRFSGSGSGQDYTLTISSLQPEDFATYYCLQYDEFPLTFGGGTKVEIKGGGGSGGGGSGGGGSQVQLVQSGAEVKKPGASVKVSCKASGYTFTNYDINWVRQAPGQGLEWIGWIYPGDGSTKYNEKFKAKATLTADTSTSTAYMELRSLRSDDTAVYYCASGYEDAMDYWGQGTTVTVSSAKPTTTPAPRPPTPAPTIASQPLSLRPEACRPAAGGAVHTRGLDFACDITRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7520 - protein, 574 aa, Artificial Sequence
  Synthetic Polypeptide encoding a Bispecific T cell engager antibody
MALPVTALLLPLALLLHAARPEIVLTQSPLSLPVTPGEPASISCRSSQSLLHSNGYNYLDWYLQKPGQSPQLLIYLGVNSVSGVPDRFSGSGSGTDFTLKISRVEAEDVGVYYCMQALQTPWTFGQGTKVEIKGGGGSGGGGSGGGGSQVQLVQSGAEVKKPGSSVKVSCKASGGIFSNHAISWVRQAPGQGLEWMGGIIPIFGTANYAQKFQGRVTITADESTSTAFMELSSLRSEDTAVYYCAREWADVFDIWGQGTMVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7521 - protein, 573 aa, Artificial Sequence
  Synthetic Polypeptide encoding a Bispecific T cell engager antibody
MALPVTALLLPLALLLHAARPDIQMTQSPASLTVSLGQRATISCRASESVDSYGNSYLHWYQQKPGQPPQLLIYLASNLESGVPARFSGSGSRTDFTLTIDPVEADDAATYYCQQNNEDPWTFGGGTKVEIKGGGGSGGGGSGGGGSEVQLQQSGAELVKPGASVKMSCKAFGYTFTTFPIEWMKQSHGKSLEWIGNFHPYNDQTKYNEEFKGRAKLTIDRSSSTVYLELGRLTSDDSAVYYCARGYYYAFDFWGQGTTLTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7522 - protein, 570 aa, Artificial Sequence
  Synthetic Polypeptide encoding a Bispecific T cell engager antibody
MALPVTALLLPLALLLHAARPDIQMTQSPSSLSASVGDRVTITCRASQGIRNDLGWYQQKPGKAPKRLIYAASSLQSGVPSRFSGSGSGTEFTLTISSLQPEDFATYYCLQHNSYPWTFGQGTKLEIKGGGGSGGGGSGGGGSEVQLVESGGALIQPGGSLRLSCVASGFTISGNYMSWVRQAPGKGLEWVSLIYSGDSTYYADSVKGRFTISRDISKNTVYLQMNSLRVEDTAVYYCVRDGYYVSDMVVWGKGTTVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7523 - protein, 580 aa, Artificial Sequence
  Synthetic Polypeptide encoding a Bispecific T cell engager antibody
MALPVTALLLPLALLLHAARPDVLLTQSPLSLPVTLGQPASISCRSSQTIVHSNGNTYLEWFQQRPGQSPRLLIYQVSNRFSGVPDRFSGSGSGTDFTLKISRVEAEDVGVYYCFQGSHVPRTFGGGTKVEIKRGGGGSGGGGSGGGGSQIQLVQSGSELKKPGASVKVSCKASGYTFTNYGMNWVRQAPGQGLKWMGWINTNTGEPKYAEEFKGRFALSLDTSVSTAYLQINSLKAEDTAVYFCARGYGNYARGAWLAYWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7524 - protein, 567 aa, Artificial Sequence
  Synthetic Polypeptide encoding a Bispecific T cell engager antibody
MALPVTALLLPLALLLHAARPDEIVLTQSPATLSLSPGERATLSCSASSSINYIYWLQQKPGQAPRILIYLTSNLASGVPARFSGSGSGTDFTLTISSLEPEDFAVYYCLQWSSNPLTFGGGTKVEIKGGGGSGGGGSGGGGSFEVQLVESGGGLVKPGGSLRLSCAASGFTFSSYDMSWVRQAPGKGLEWVSTISSGGSYTYYLDSIKGRFTISRDNAKNSLYLQMNSLRAEDTAVYYCARQGLDYWGRGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7525 - protein, 575 aa, Artificial Sequence
  Synthetic Polypeptide encoding a Bispecific T cell engager antibody
MALPVTALLLPLALLLHAARPDIVMTQSPDSLAVSLGERATINCRASKSVSTSGYSFMHWYQQKPGQPPKLLIYLASNLESGVPDRFSGSGSGTDFTLTISSLQAEDVAVYYCQHSREVPWTFGQGTKVEIKRGGGGSGGGGSGGGGSQVQLVQSGAEVKKPGASVKVSCKASGYTFTNYGMNWVRQAPGQGLEWMGWINTYTGEPTYADAFKGRFAFSLDTSTSTAYLQINSLRSDDTAVYYCARDYGDYGMDYWGQGTTVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7526 - protein, 571 aa, Artificial Sequence
  Synthetic Polypeptide encoding a Bispecific T cell engager antibody
MALPVTALLLPLALLLHAARPDIVMTQTPLTLSVTIGQPASISCKSSQSLLDSDGKTYLNWLLQRPGQSPERLIYLVSKLDSGVPDRFTGSGSGTDFTLKISRVEAEDLGVYCCWQGTHFPYTFGGGTKVEIKGGGGGSGGGGSGGGGSQVQLQQPGAELVRPGASVKLSCKASGYTFTSYWMNWVKQRPGQGLEWIGMIDPSDSETHYNHIFKDKATLTVDKSSSTAYLQLSSLTSEDSAVYYCARNLYLWGQGTSVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7527 - protein, 575 aa, Artificial Sequence
  Synthetic Polypeptide encoding a Bispecific T cell engager antibody
MALPVTALLLPLALLLHAARPDDIQLTQSPSSLSASVGDRVTITCKASQSVDYEGDSFLNWYQQKPGKAPKLLIYAASNLESGVPSRFSGSGSGTDFTLTISSLQPEDFATYYCQQSNEDPLTFGQGTKVEIKRGGGGSGGGGSGGGGSEVQLVESGGGLVQPGGSLRLSCAASGYTFSSYWIEWVRQAPGKGLEWIGEILPGGGDTNYNEIFKGRATFSADTSKNTAYLQMNSLRAEDTAVYYCTRRVPIRLDYWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7528 - protein, 571 aa, Artificial Sequence
  Synthetic Polypeptide encoding a Bispecific T cell engager antibody
MALPVTALLLPLALLLHAARPDIVMTQTPLSLSVTPGQPASISCKSSQSLLDGDGKTYLNWLLQKPGQSPQRLIYLVSKLDSGVPDRFSGSGSGTDFTLKISRVEAEDVGVYYCWQGTHFPRTFGQGTKLEIKGGGGSGGGGSGGGGSQVQLVQSGAEVKKPGASVKVSCKASGYTFKDTYIHWVRQAPGQGLEWMGRIDPANGNTKYDPKFQGRVTMTRDTSISTAYMELSRLRSDDTAVYYCARRGGVDWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7529 - protein, 579 aa, Artificial Sequence
  Synthetic Polypeptide encoding a Bispecific T cell engager antibody
MALPVTALLLPLALLLHAARPDIVMTQSPDSLAVSLGERATINCESSQSLLNSGNQKNYLTWYQQKPGQPPKPLIYWASTRESGVPDRFSGSGSGTDFTLTISSLQAEDVAVYYCQNDYSYPYTFGQGTKLEIKRGGGGSGGGGSGGGGSEVQLVQSGAEVKKPGESLKISCKGSGYSFTDYYMKWARQMPGKGLEWMGDIIPSNGATFYNQKFKGQVTISADKSISTTYLQWSSLKASDTAMYYCARSHLLRASWFAYWGQGTMVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7530 - protein, 574 aa, Artificial Sequence
  Synthetic Polypeptide encoding a Bispecific T cell engager antibody
MALPVTALLLPLALLLHAARPDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKGGGGSGGGGSGGGGSQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7531 - protein, 578 aa, Artificial Sequence
  Synthetic Polypeptide encoding a Bispecific T cell engager antibody
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKGGGGSGGGGSGGGGSEVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7532 - protein, 578 aa, Artificial Sequence
  Synthetic Polypeptide encoding a Bispecific T cell engager antibody
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKGGGGSGGGGSGGGGSQVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7533 - protein, 572 aa, Artificial Sequence
  Synthetic Polypeptide encoding a Bispecific T cell engager antibody
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQDYGFPWTFGQGTKVEIKRGGGGSGGGGSGGGGSEVQLVQSGAEVKKPGESLKISCKGSGYSFTSYWISWVRQMPGKGLEWMGIIDPSDSDTRYSPSFQGQVTISADKSISTAYLQWSSLKASDTAMYYCARGDGSTDLDYWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7534 - protein, 574 aa, Artificial Sequence
  Synthetic Polypeptide encoding a Bispecific T cell engager antibody
MALPVTALLLPLALLLHAARPQFVLTQPPSVSTNPGSTVKLSCKRNTGNIGSNYVNWYQQKPGQSPTTMIYRDDKRPDGVPDRFSGSIDRSSNSALLTINNVQTEDEADYFCQSYSSGINIIFGGGTKLTVLGGGGSGGGGSGGGGSQVQLQESGPGLVKPSETLSLTCTVSGFSLTTYDVHWVRQPPGKGLEWMGRIQNAGITDYNSALKSRLIISRDTSKSQVFLKMNSVTTADTAMYFCAKTGSYFYAFDHWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7535 - protein, 571 aa, Artificial Sequence
  Synthetic Polypeptide encoding a Bispecific T cell engager antibody
MALPVTALLLPLALLLHAARPDIQMTQSPASLSASLGETVTIECRPSEDIHSNVAWYQQKPGNSPQLLIYDASNLADGVPSRFSGSGSGTQYSLKINSLQSEDVASYFCHQYNIYPYTFGSGTKLELKGGGGSGGGGSGGGGSQVQLQESGPTLVKPGDSVKMSCKASGYTFTDYIIHWVKQSHGKSLEWIGYINPYSDGTNYNEKFKSKATLTVDKSTSTAYMEFSRLTSEDSAIYFCALNYGSYYAMDAWGQGTSVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7536 - protein, 572 aa, Artificial Sequence
  Synthetic Polypeptide encoding a Bispecific T cell engager antibody
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGQGTKVEIKRGGGGSGGGGSGGGGSEVQLLESGGGLVQPGGSLRLSCAASGFTFSGYWMHWVRQAPGKGLEWVSAIRSDGSSKYYADSVKGRFTISRDNSKNTLYLQMNSLRAEDTAVYYCAKDGVIEDTFDYWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7537 - protein, 568 aa, Artificial Sequence
  Synthetic Polypeptide encoding a Bispecific T cell engager antibody
MALPVTALLLPLALLLHAARPDVQITQSPSYLAASPGETITINCRASKSISKDLAWYQEKPGKTNKLLIYSGSTLQSGIPSRFSGSGSGTDFTLTISSLEPEDFAMYYCQQHNKYPYTFGGGTKLEIKRGGGGSGGGGSGGGGSQVQLQQPGAELVRPGASVKLSCKASGYTFTSYWMNWVKQRPDQGLEWIGRIDPYDSETHYNQKFKDKAILTVDKSSSTAYMQLSSLTSEDSAVYYCARGNWDDYWGQGTTLTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7538 - protein, 599 aa, Artificial Sequence
  Synthetic Polypeptide encoding a Bispecific T cell engager antibody
MALPVTALLLPLALLLHAARPYINIYNAEPANPSEKNSPTQYAYGSGEFDIQMTQSPASLSASLGETVTIECRTSKDIYSNLAWFQQEPGNSPQLLIYDASNLADGVPSRFSGSGSGTQYSLQINNLQSEDVASYFCHQYNNYPYTFGTGTKLELKGGGGSGGGGSGGGGSQVQLQESGPTLVNPGDSVKMSCKASGYTFTDHIIHWVKQSHGKSLEWIGYINPYSGGANYNGKFKSKATLTIDKSSSTAYMEFSRLTSGDSAIYYCALNYGSYYAMDAWGQGTSVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7539 - protein, 570 aa, Artificial Sequence
  Synthetic Polypeptide encoding a Bispecific T cell engager antibody
MALPVTALLLPLALLLHAARPEIVLTQSPTSMTASPGEQVTITCRASSSINYMHWYQQKPGASPRPWIYETSKLASGVPDRFSGSASGTSYSLTINNMEAEDAATYYCQQWNYPSWTFGGGTKLELKGGGGSGGGGSGGGGSEVQLVESGGGLVQPGRSLKLSCAASGFTFSDYNMAWVRQAPKKGLEWVATILYDGGRTYYRGSVKGRFTISRDNAKSTLYLRMDSLRSEDTATYYCATHSRGTDYFDYWGQGVMVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7540 - protein, 579 aa, Artificial Sequence
  Synthetic Polypeptide encoding a Bispecific T cell engager antibody
MALPVTALLLPLALLLHAARPDIVMTQSPSSLAVSEGETVTINCKSSQSFLSSGDGKNYVAWYQYKPGQSPKLLIYWASTRQSGVPDRFIGSGSGTDFTLTISTVQAEDLAIYYCQQYYDTPLTFGSGTKLEIKGGGGSGGGGSGGGGSEVKLQESGPSLVQSSQTLSLTCTVSGFSLTSYHIHWVRQTPGKGLEWMGVMWSDGDTSYNSALKSRLSISRDTSQSQVFLKMNSLQTEDTATYYCARGYYSSYLYLWFAYWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7541 - protein, 583 aa, Artificial Sequence
  Synthetic Polypeptide encoding a Bispecific T cell engager antibody
MALPVTALLLPLALLLHAARPDVLMTQTPVSLPVSLGGQVSISCRSSQSLVHSDGDTYLHWYLQKPGQSPQLLIYRVSNRFSGVPDRFSGSGSGTDFTLKISRVEPEDLGLYYCLQTTHFPPWTFGGGTKLEMKGGGGSGGGGSGGGGSQVQLQQSGPELRRPGSSVRLSCKASGYRIKDFLIHWIKNRPEHGLEWIGWIDPEDGETKYAQKFQTKATLTADTSSNTAYMQLSSLTSEDTATYFCARWGDVYYGLMRGHVMDAWGQGTSVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7542 - protein, 574 aa, Artificial Sequence
  Synthetic Polypeptide encoding a Bispecific T cell engager antibody
MALPVTALLLPLALLLHAARPDIQMTQSTSSLSASLGDRVTISCSASQGINNYLNWYQQKPDGTVELLIYYTSTLQSGVPSRFSGSGSGTDYSLTISNLEPEDIGTYYCQQYSKLPRTFGGGTKLEIKGGGGSGGGGSGGGGSQVQLQQSGSELMMPGASVKISCKATGYTFSNYWIEWVKQRPGHGLEWIGEILPGTGRTIYNEKFKGKATFTADISSNTVQMQLSSLTSEDSAVYYCARRDYYGNFYYAMDYWGQGTSVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7543 - protein, 569 aa, Artificial Sequence
  Synthetic Polypeptide encoding a Bispecific T cell engager antibody
MALPVTALLLPLALLLHAARPDIQMTQSPASLSVSVGETVTITCRASENIYSNLAWYQQKQGKSPQLLVYAATNLADGVPSRFSGSGSGTQYSLKINSLQSEDFGSYYCQHFWGTWTFGGGTTLEIKGGGGSGGGGSGGGGSEVQLQQSGPELVKPGASVKMSCKASGYTFTDYYMKWMKQSHGKSLEWIGDINPNNGGTTYNQKFKGKATLTVDKSSSTAYMQLNSLTSEDSAVYYCARDYGYGYFDYWGQGTTLTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7544 - protein, 572 aa, Artificial Sequence
  Synthetic Polypeptide encoding a Bispecific T cell engager antibody
MALPVTALLLPLALLLHAARPEIVLTQSPGTLSLSPGERATLSCRASQSVGGYLAWYQQKPGQAPRLLIYDASNRATGIPARFSGSGSGTDFTLTISSLEPEDFAVYYCQQRNNWPPMYTFGQGTKLEIKRGGGGSGGGGSGGGGSQVQLVQSGAEVKKPGSSVKVSCKASGGTFSSYAISWVRQAPGQGLEWMGGIIPILGTANYAQKFQGRVTITADESTSTAYMELSSLRSEDTAVYYCARWGGGAFDIWGQGTMVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7545 - protein, 567 aa, Artificial Sequence
  Synthetic Polypeptide encoding a Bispecific T cell engager antibody
MALPVTALLLPLALLLHAARPQIVLTQSPALMSASPGEKVTMTCSASSSVRYMYWYQQKPRSSPKPWIHLTSNLASGVPARFSGSGSGTSYSLTISSMEAEDAATYYCQQWSSHPFTFGSGTKLEIKGGGGSGGGGSGGGGSDVQLQESGPGLVKPSQSLSLTCTVTGFSITSDYSWNWIRQFPGNKLEWMGYISYSGHTSYNPSLESRISITRDTSKNQFFLQLNSVTTEDTATYYCTRGNWDVVYWGQGTLVTVSATRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7546 - protein, 577 aa, Artificial Sequence
  Synthetic Polypeptide encoding a Bispecific T cell engager antibody
MALPVTALLLPLALLLHAARPDVVMTQSPLSLPVTLGQPASISCRSSQSIVHSDGNTYLEWYQQRPGQSPRRLIYKVSNRFSGVPDRFSGSGSGTDFTLKISRVEAEDVGVYYCFQGSHAPWTFGGGTKVEIKGGGGSGGGGSGGGGSEVQLVESGGGLVQPGGSLRLSCAASGFTFSSYGMHWVRQAPGKGLEWVAYITTRSSTIYYADSVKGRFTISRDNAKNSLYLQMNSLRAEDTAVYYCTREPLTGYYAMDYWGQGTSVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7547 - protein, 569 aa, Artificial Sequence
  Synthetic Polypeptide encoding a Bispecific T cell engager antibody
MALPVTALLLPLALLLHAARPDIQMTQSPSSLSASVGDRVTITCRASQSISLWLNWYQQKPGKAPKLLIYAASTLQSGVPSRFSGSGSGTDFTLTISSLQPEDFATYYCQQYYTSPYTFGQGTKVEIKRGGGGSGGGGSGGGGSQVQLLESGGGLVQPGGSLRLSCAASGFTFSSYAMSWVRQAPGKGLEWVSVIRSSGSSTYYADSVKGRFTISRDNSKNTLYLQMNSLRAEDTAVYYCARGGGYFDYWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7548 - protein, 572 aa, Artificial Sequence
  Synthetic Polypeptide encoding a Bispecific T cell engager antibody
MALPVTALLLPLALLLHAARPDIQMTQSPSSLSASVGDRVTITCRASQSISSYLNWYQQKPGKAPKLLIYAVSTLQSGVPSRFSGSGSGTDFTLTISSLQPEDFATYYCQQSGTFPPTTFGQGTKVEIKRGGGGSGGGGSGGGGSQVQLLESGGGLVQPGGSLRLSCAASGFTFSSHGMHWVRQAPGKGLEWVSVISGSGSNTGYADSVKGRFTISRDNSKNTLYLQMNSLRAEDTAVYYCARQWGSYAFDSWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7549 - protein, 582 aa, Artificial Sequence
  Synthetic Polypeptide encoding a Bispecific T cell engager antibody
MALPVTALLLPLALLLHAARPDIVMSQSPSSLAVSVGEKVTMSCKSSQSLLHSSNQKNYLAWYQQKPGQSPKVLIYWASTRESGVPDRFTGSGSGTDFTLTITSVKSEDLAVYYCQQYYSYPWTFGGGTRLEIKRGGGGSGGGGSGGGGSEVQLQQSVAELVKPGASVKMSCKVSGYTLTDHTIHWMKQRPEQGLEWIGYIYPRDGITGYNEKFKGKATLTADTSSSTAYMQLNSLTSEDSAVYFCARWGYSYRNYAYYYDYWGQGTTLTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7550 - protein, 579 aa, Artificial Sequence
  Synthetic Polypeptide encoding a Bispecific T cell engager antibody
MALPVTALLLPLALLLHAARPEIVLTQSPGTLSLSPGERATLSCRASQSVSSSYLAWYQQKPGQAPRLLIYGTSSRATGIPDRFSGSGSGTDFTLTISRLEPEDFAVYYCQQYGSSPFTFGGGTKVEIKRGGGGSGGGGSGGGGSQVQLQESGPGLAKPSETLSLTCTVSGDSITSYYWSWIRQPPGKGLEWIGYIYYSGSTNYNPSLKSRVTISVDTSKNQFSLKLSSVTAADTAVYYCARDQRRIAAAGTHFYGMDVWGQGTTVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7551 - protein, 571 aa, Artificial Sequence
  Synthetic Polypeptide encoding a Bispecific T cell engager antibody
MALPVTALLLPLALLLHAARPDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKGGGGSGGGGSGGGGSQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSATRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7552 - protein, 564 aa, Artificial Sequence
  Synthetic Polypeptide encoding a Bispecific T cell engager antibody
MALPVTALLLPLALLLHAARPMTQSPKFLLVSAGDRVTLTCKASQSVNNDVYWYQQEPGQSPKLLIYWASTRESGVPDRFTGSGSGTDFTLTISSVQAEDLAVYYCKQSYNLYTFGGGTKLEIKRGGGGSGGGGSGGGGSESGRGLVQPGGSRKLSCAASGFTFSTSGMHWVRQAPEKGLEWVAYISSGSTTIYHADTVKGRFTISRDNPKNTLFLQMTSLRSEDTAMYYCCARSGQFGNYFDYWGQGTTLTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7553 - protein, 569 aa, Artificial Sequence
  Synthetic Polypeptide encoding a Bispecific T cell engager antibody
MALPVTALLLPLALLLHAARPQSPSSLAVSAGEKVTMSCKSSQSLLNSRTRKNYLAWYQQKPGQSPKLLIYWASTRESGVPDRFTGSGSGTDFTLTISSVQAEDLAVYYCKQSNLYTFGGGTKLEIKGGGGSGGGGSGGGGSQVQLEESGPELVKPGASVKLSCKASGYTFTEYIIHWVKQRSGQGLEWIGWFYPGSGSIKYNEKFKDKATLTADKSSSTVYMELSGLTSEDSAVYFCARHDGYSYFDYWGQGTTLTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7554 - protein, 581 aa, Artificial Sequence
  Synthetic Polypeptide encoding a Bispecific T cell engager antibody
MEMFQGLLLLLLLSMGGTWASREMLRPRCRPINATLAVEKEGCPVCITVNTTICAGYCPTMTRVLQGVLPALPQVVCNYRDVRFESIRLPGCPRGVNPVVSYAVALSCQCALCRRSTTDCGGPKDHPLTCDDPRFQASSSSKAPPPSLPSPSRLPGPSDTPILPQGGGGSGGGGSGGGGSAPDVQDCPECTLQENPFFSQPGAPILQCMGCCFSRAYPTPLRSKKTMLVQKNVTSESTCCVAKSYNRVTVMGGFKVENHTACHCSTCYYHKSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7555 - protein, 572 aa, Artificial Sequence
  Synthetic Polypeptide encoding a Bispecific T cell engager antibody
MALPVTALLLPLALLLHAARPDIQMTQSPSSLSASLGERVSLTCRATQELSGYLSWLQQKPDGTIKRLIYAASTLDSGVPKRFSGNRSGSDYSLTISSLESEDFADYYCLQYAIYPYTFGGGTKLEIKGGGGSGGGGSGGGGSEVQLQQSGPELVKPGASVKMSCKASGYTFTSYFIHWVKQKPGQGLEWIGFINPYNDGSKYNEKFKGKATLTSDKSSSTAYMELSSLTSEDSAVYYCTRDDGYYGYAMDYWGQGTSVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7556 - protein, 577 aa, Artificial Sequence
  Synthetic Polypeptide encoding a Bispecific T cell engager antibody
MALPVTALLLPLALLLHAARPDTIVLTQSPASLAVSLGQRATISCRASESVDSYGNSFMHWYQQKPGQPPKLLIYLASNLESGVPARFSGSGSRTDFTLTIDPVEADDAATYYCQQNNYDPWTFGGGTKLEIKGGGGSGGGGSGGGGSEVQLQQSGPELVKPGASVKMSCKASGYTFTSYVMHWVKQKPGQGLEWIGYINPYNDGTKYNEKFKGKATLTSDTSSSTAYMELNSLTSEDSAVYFCARPIYFDNDYFDYWGQGTTLKVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7557 - protein, 572 aa, Artificial Sequence
  Synthetic Polypeptide encoding a Bispecific T cell engager antibody
MALPVTALLLPLALLLHAARPDIQMTQSPSSLSASVGDRVTITCKASQDVSTAVAWFQQKPGKAPKLLIYSPSYRYTGVPSRFSGSGSGTDFTLTISSLQPEDFTYYCQQLYSTPYTFGQGTKVEIKGGGGSGGGGSGGGGSEVQLVQSGAEVKKPGASVKVSCKASGYTFTDYYLDVVVRQAPGQGLEWIGRVNPYNGGTIYNQKFKGRVTLTRDTSTSTAYLELSSLRSEDTAVYYCARDHYRYDPLLDYWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7558 - protein, 578 aa, Artificial Sequence
  Synthetic Polypeptide encoding a Bispecific T cell engager antibody
MALPVTALLLPLALLLHAARPDIQMTQSPSSLSASVGDRVTITCRASQSVSTSSYNYMHWYQQKPGKPPKLLIKYASNLESGVPSRFSGSGSGTDFTLTISSLQPEDFATYYCQHSWEIPLTFGQGTKVEIKGGGGSGGGGSGGGGSEVQLVQSGAEVKKPGASVKVSCKASGYSFTDYYMHWVRQAPGQGLEWIGRINPYNGAAFYSQNFKDRVTLTVDTSTSTAYLELSSLRSEDTAVYYCAIERGADLEGYAMDYWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7559 - protein, 576 aa, Artificial Sequence
  Synthetic Polypeptide encoding a Bispecific T cell engager antibody
MALPVTALLLPLALLLHAARPEIVLTQSPATLSASPGERVTLTCRASSNVISSYVHWYQQKPGSSPRLFLYSTSNLASGVPSRFSGSGSGTDFTFTISSLEAEDAATYYCQQYSGYPLTFGQGTRLEIKGGGGSGGGGSGGGGSQVQLQESGPGLVKPSETLSLTCAVSGYSITSAYYWNWIRQPPGKGLEWIGYISYDGRNNYNPSLKNRITINPDTSKNQFSLQLNSVTPEDTAVYYCAREGDYDVGNYYAMDYWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7560 - protein, 576 aa, Artificial Sequence
  Synthetic Polypeptide encoding a Bispecific T cell engager antibody
MALPVTALLLPLALLLHAARPEIVLTQSPATLSLSPGERATLSCRASSNVISSYVHWYQQKPGQAPRLLIYSTSNLASGIPARFSGSGSGTDFTLTISSLEPEDFAVYYCQQYSGYPLTFGQGTRLEIKGGGGSGGGGSGGGGSEVQLVESGGGLVQPGRSLRLSCAASGYSITSAYYWNWVRQAPGKGLEWVSYISYDGRNNYNPSLKNRFTISRDNAKKSLYLQMNSLRAEDTALYYCAKEGDYDVGNYYAMDYWGQGTTVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7561 - protein, 588 aa, Artificial Sequence
  Synthetic Polypeptide encoding a Bispecific T cell engager antibody
MALPVTALLLPLALLLHAARPDLNFMLTQPHSVSGSPGKTVTISCTRSTGSITSNYVHWYQQRPGSSPTTVICEDNERPSGVPDRFSGSIDISSNSASLTISGLKTEDEADYYCQSYDDSNHISVFGTGTKVTVLGQPKANPGGGGSGGGGSGGGGSQVQLQESGPGLVKPSETLSLTCTVSGGSISSSNYYWGWIRQPPGKGLEWIGAIYYSGSTYYNPSLKSRVAISVDTSKNQFSLKLSSVTAADTAVYYCARRIGVAGQWYFDLWGRGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7562 - protein, 574 aa, Artificial Sequence
  Synthetic Polypeptide encoding a Bispecific T cell engager antibody
MALPVTALLLPLALLLHAARPDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKGGGGSGGGGSGGGGSQIQLVQSGPDLKKPGETVKISCKASGYTFTNTGMNWVKQAPGKGLKWMGWINTYTGEPTYADDFKGRFTFSLETSASTAYLQINNLKNEDTATYFCTRWGYGSSLYYAMDYWGQGTSVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7563 - protein, 571 aa, Artificial Sequence
  Synthetic Polypeptide encoding a Bispecific T cell engager antibody
MALPVTALLLPLALLLHAARPDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKGGGGSGGGGSGGGGSEVQLVESGGGLVQPGGSLRLSCAASGFDFSRYWMSWVRQAPGKGLEWIGEINPDSSTINYAPSLKDKFIISRDNAKNSLYLQMNSLRAEDTAVYYCARPDGNYWYFDVWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7564 - protein, 572 aa, Artificial Sequence
  Synthetic Polypeptide encoding a Bispecific T cell engager antibody
MALPVTALLLPLALLLHAARPDIVMTQSQKSMSTSVGDRVSITCKASQDVITGVAWYQQKPGQSPKLLIYSASYRYTGVPDRFTGSGSGTDFTFTISNVQAEDLAVYYCQQHYSTPLTFGAGTKLELKGGGGSGGGGSGGGGSQVQLQQPGAELVRPGASVKLSCKASGYSFTTYWMNWVKQRPGQGLEWIGMIHPSDSETRLNQKFKDKATLTVDKSSSTAYMQLSSPTSEDSAVYYCARSTMIATRAMDYWGQGTSVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7565 - protein, 574 aa, Artificial Sequence
  Synthetic Polypeptide encoding a Bispecific T cell engager antibody
MALPVTALLLPLALLLHAARPDIQMTQSPSSLSASVGDRVTITCKASQDVSTAVAWYQQKPGKAPKLLIYSASYRYTGVPDRFTGSGSGTDFTLTISSLQPEDFATYYCQQHYSTPPYTFGGGTKVEIKRGGGGSGGGGSGGGGSQVQLVQSGAEVKKPGASVKVSCKASGYAFSSSWMNWVRQAPGQGLEWIGRIYPGDGDTKYNGKFKGKATLTADKSTSTAYMELSSLRSEDTAVYYCARSTMIATGAMDYWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7566 - protein, 575 aa, Artificial Sequence
  Synthetic Polypeptide encoding a Bispecific T cell engager antibody
MALPVTALLLPLALLLHAARPDVVMTQTPLSLSVTPGQPASISCRSSQSLVHNNGNTYLHWYLQKPGQSPQLLIYKVSNRFSGVPDRFSGSGSGTDFTLKISRVEAEDVGVYFCSQSTHVPPYTFGGGTKVEIKGGGGSGGGGSGGGGSEVQLVESGGGLVQPGGSLRLSCAASGFTFSDYYMAWVRQAPGKGLEWVAEINYDGSSTYYVDSVKGRFTISRDNAKNSLYLQMNSLRAEDTAVYYCARDRGFYFDYWGQGTTVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7567 - protein, 575 aa, Artificial Sequence
  Synthetic Polypeptide encoding a Bispecific T cell engager antibody
MALPVTALLLPLALLLHAARPDVVMTQTPLSLSVTPGQPASISCRSSQSLVHSNGLTYLHWYLQKPGQSPQLLIYKVSNRFSGVPDRFSGSGSGTDFTLKISRVEAEDVGVYFCSQSTHVPPFTFGGGTKVEIKGGGGSGGGGSGGGGSEVQLVESGGGLVQPGGSLRLSCAASGFTFSDYYMAWVRQAPGKGLEWVASINYDGESTYYVDSVKGRFTISRDNAKNSLYLQMNSLRAEDTAVYYCARDRGYYFDYWGQGTTVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7568 - protein, 575 aa, Artificial Sequence
  Synthetic Polypeptide encoding a Bispecific T cell engager antibody
MALPVTALLLPLALLLHAARPDVVMTQSPLSLPVTPGEPASISCRSSQSLVHSNGNTYLHWYLQKPGQSPQLLIYKVSNRFSGVPDRFSGSGSGTDFTLKISRVEAEDVGVYFCSQSTHVPPFTFGGGTKVEIKGGGGSGGGGSGGGGSEVQLVESGGGLVQPGGSLRLSCAASGFTFSDYYMAWVRQAPGKGLEWVADINYDGGSTYYLDSLKSRFTISRDNAKNSLYLQMNSLRAEDTAVYYCARDRGYYFDYWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7569 - protein, 573 aa, Artificial Sequence
  Synthetic Polypeptide encoding a Bispecific T cell engager antibody
MALPVTALLLPLALLLHAARPDIQMTQSSSYLSVSLGGRVTITCKASDHINNWLAWYQQKPGNAPRLLISGATSLETGVPSRFSGSGSGKDYTLSITSLQTEDVATYYCQQYWSTPWTFGGGTKLEIKGGGGSGGGGSGGGGSQVQLQQSGAELARPGASVKLSCKASGYTFTSYWMQWVKQRPGQGLEWIGAIYPGDGDTRYTQKFKGKATLTADKSSSTAYMQLSSLASEDSAVYYCARGKVYYGSNPFAYWGQGTLVTVSATRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7570 - protein, 573 aa, Artificial Sequence
  Synthetic Polypeptide encoding a Bispecific T cell engager antibody
MALPVTALLLPLALLLHAARPDIVMTQSHKFMSTSVGDRVSITCKASQDVSTAVAWYQQKPGQSPKLLIYSASYRYTGVPDRFTGSGSGTDFTFTISSVQAEDLAVYYCQQHYSTPPYTFGGGTKLEIKGGGGSGGGGSGGGGSQVQLQQSGPELVKPGASVKISCKASGYAFSSSWMNWVKQRPGQGLEWIGRIYPGDGDTKYNGKFKGKATLTADKSSSTAYMQLSSLTSVDSAVYFCARSTMIATGAMDYWGQGTSVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7571 - protein, 578 aa, Artificial Sequence
  Synthetic Polypeptide encoding a Bispecific T cell engager antibody
MALPVTALLLPLALLLHAARPQSVLTQPPSVSGAPGQRVTISCTGSGSNIGAPYDVSWYQQLPGTAPKLLIYHNNKRPSGVPDRFSGSKSGTSASLAITGLQAEDEADYYCATVEAGLSGSVFGGGTKLTVLGAGGGGSGGGGSGGGGSQVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSPLTLGLWGQGTMVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7572 - protein, 578 aa, Artificial Sequence
  Synthetic Polypeptide encoding a Bispecific T cell engager antibody
MALPVTALLLPLALLLHAARPQSVLTQPPSVSGAPGQRVTISCTGSGSNIGAPYDVSWYQQLPGTAPKLLIYHNNKRPSGVPDRFSGSKSGTSASLAITGLQAEDEADYYCQSYDSSSISTIFGGGTKLTVLGAGGGGSGGGGSGGGGSQVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSGIAYRPWGQGTMVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7573 - protein, 589 aa, Artificial Sequence
  Synthetic Polypeptide encoding a Bispecific T cell engager antibody
MALPVTALLLPLALLLHAARPDEFEVQLVESGGGLVQAGGSLRLSCVASGISSSKRNMGWYRQAPGKQRESVATISSGGNKDYTDAVKDRFTISRDTTKNTVYLQMNSLKPEDTAVYYCKIEAGTGWATRRGYTYWGQGTLVTVSSLEGGGGSGGGGSGGGGSFEVQLVESGGGLVQAGGSLRLSCAASGSIFSGNVMGWYRRQAPGKEREWVAAIASGGSIYYRDSVKGRFTISRDNAKNTVYLQMNSLKPEDTAVYYCNSHPPTLPYWGLGTQVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7574 - protein, 623 aa, Artificial Sequence
  Synthetic Polypeptide encoding a Bispecific T cell engager antibody
MALPVTALLLPLALLLHAARPDEFEVQLVESGGGLVQAGDSLRLSCAASGRAFSRYAMGWFRQAPGKEREFVAAIGWGPSKTNYADSVKGRFTISRDNAKNTVYLQMNTLKPEDTAVYSCAAKFVNTDSTWSRSEMYTYWGQGTLVTVSSLEGGGGSGGGGSGGGGSGSGGSGSGGSGSGGSGSGGSFEVQLVESGGGSVQAGGSLRLSCTTSGRALNMYVMGWFRQAPGNEREFVAATSSSGGSTSYPDSVKGRFTISRDNAKNTVYLQMNSLKPEDTAAYRCAASPYVSTPTMNILEEYRYWGLGTQVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7575 - protein, 576 aa, Artificial Sequence
  Synthetic Polypeptide encoding a Bispecific T cell engager antibody
MALPVTALLLPLALLLHAARPDIQMTQSPSSLSASVGDRVTITCSASSSVSYMYWYQQKPGKAPKLLIYLTSNLASGVPSRFSGSGSGTDFTLTISSLQPEDFATYYCQQWRSNPFTFGQGTKLEIKRGGGGSGGGGSGGGGSQITLKESGPTLVKPTQTLTLTCTFSGFSLSTSGMGVGWIRQPPGKALEWLAHIWWDDVKRYSPSLKSRLTITKDTSKNQVVLTMTNMDPVDTATYYCARIVSFDNDVVSAMDYWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7576 - protein, 571 aa, Artificial Sequence
  Synthetic Polypeptide encoding a Bispecific T cell engager antibody
MALPVTALLLPLALLLHAARPEIVMTQSPATLSVSPGERATLSCKASQSVSNDVVWYQQKPGQAPRLLIYYASNRYTGIPARFSGSGSGTEFTLTISSLQSEDFAVYYCQQDYTSPWTFGQGTKLEIKRGGGGSGGGGSGGGGSQVQLVQSGAEVKKPGASVKVSCKASGYTFTNYGMNWVRQAPGQGLEWMGWINTYTGEPTYADDFKGRVTMTTDTSTSTAYMELRSLRSDDTAVYYCARIGDSSPSDYWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7577 - protein, 572 aa, Artificial Sequence
  Synthetic Polypeptide encoding a Bispecific T cell engager antibody
MALPVTALLLPLALLLHAARPDSTDIQMTQSPSSLSASVGDRVTITCRASQSISSYLNWYQQKPGKAPKLLIYLASNLQSGVPSRFSGSGSGTDFTLTISSLQPEDFATYYCQQAEYMPLTFGQGTKVEIKRAGGGGSGGGGSGGGGSEVQLLESGGGLVQPGGSLRLSCAASGFTFSGYAMSWVRQAPGKGLEWVSEIAPPGLNTRYADSVKGRFTISRDNSKNTLYLQMNSLRAEDTAVYYCAKSDTAFDYWGQGTLVTVSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7578 - protein, 575 aa, Artificial Sequence
  Synthetic Polypeptide encoding a Bispecific T cell engager antibody
MALPVTALLLPLALLLHAARPDQAVLTQESALTTSPGETVTLTCRSSTGAVTTSNYANWVQEKPDHLFTGLIGGTNNRVPGVPARFSGSLIGDKAALTITGAQTEDEAIYFCVLWHSNHWVFGGGTKLTVLGGGGSGGGGSGGGGSDVQLVESGGGLVQPGGSRKLSCAASGFTFSSFGMHWVRQAPEKGLEWVAYISSGSSTLHYADTVKGRFTISRDNPKNTLFLQMTSLRSEDTAMYYCARWGNYPHYAMDYWGQGTSVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7579 - protein, 457 aa, Artificial Sequence
  Synthetic Polypeptide encoding a Bispecific T cell engager antibody
MALPVTALLLPLALLLHAARPDEFEVQLVESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7580 - protein, 599 aa, Artificial Sequence
  Synthetic Polypeptide encoding a Bispecific T cell engager antibody
MALPVTALLLPLALLLHAARPDEFEVQLVESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTLVTVSSLEGGGGSGGGGSGGGGSFEEVQLVESGGGSVQAGGSLRLSCAASGDTYGSYWMGWFRQAPGKEREGVAAINRGGGYTVYADSVKGRFTISRDTAKNTVYLQMNSLRPDDTADYYCAASGVLGGLHEDWFNYWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7581 - protein, 618 aa, Artificial Sequence
  Synthetic Polypeptide encoding a Bispecific T cell engager antibody
MALPVTALLLPLALLLHAARPDEFEVQLVESGGGSVQAGGSLRLTCAASGSTSRSYGMGWFRQAPGKEREFVSGISWRGDSTGYADSVKGRFTISRDNAKNTVDLQMNSLKPEDTAIYYCAAAAGSTWYGTLYEYDYWGQGTLVTVSSLEGGGGSGGGGSGGGGSGSGGSGSGGSGSGGSGSGGSFEVQLVESGGGSVQAGGSLRLSCAASGDTYGSYWMGWFRQAPGQEREAVAAINRGGGYTVYADSVKGRFTISRDNAKNTLYLQMNSLRPDDTADYYCAASGVLGGLHEDWFNYWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7582 - protein, 566 aa, Artificial Sequence
  Synthetic Polypeptide encoding a Bispecific T cell engager antibody
MALPVTALLLPLALLLHAARPDIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVEGGGGSGGGGSGGGGSEVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7583 - protein, 572 aa, Artificial Sequence
  Synthetic Polypeptide encoding a Bispecific T cell engager antibody
MALPVTALLLPLALLLHAARPDEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSGGGGSGGGGSGGGGSDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7584 - protein, 579 aa, Artificial Sequence
  Synthetic Polypeptide encoding a Bispecific T cell engager antibody
MALPVTALLLPLALLLHAARPDELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7585 - protein, 580 aa, Artificial Sequence
  Synthetic Polypeptide encoding a Bispecific T cell engager antibody
MALPVTALLLPLALLLHAARPDELQMTQSPSSLSASVGDRVTITCRASQSISSYLNWYQQKPGQPPKLLIYWASTRESGVPDRFSGSESGTNYTLTISSLQPEDFATYFCQQSDSLPITFGQGTRLDIQGGGGSGGGGSGGGGSEVQLLESGGGVVQPGRSLRLSCAASGFTFSSYGMHWVRQAPGKGLEWVAVISYDGSNKYYADSVKGRFTISRDNSKNTLYLQMNSLRAEDTAVYYCAKDMGWGSGWRPYYYYGMDVWGQGTTVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7586 - protein, 577 aa, Artificial Sequence
  Synthetic Polypeptide encoding a Bispecific T cell engager antibody
MALPVTALLLPLALLLHAARPDDIQMTQSPSSLSASVGDRVTITCRASQSISSYLNWYQQKPGKAPKLLIYAASSLQSGVPSRFSGSGSGTDFTLTISSLQPEDLATYYCQQSYSTPFTFGPGTKVDIKGGGGSGGGGSGGGGSVHEVQLVQSGAEVKKPGSSVKVSCKASGGTFSSYAISWVRQAPGQGLEWMGGIIPIFGTANYAQKFQGRVTITADKSTSTAYMELSSLRSEDTAVYYCATFALFGFREQAFDIWGQGTTVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7587 - protein, 574 aa, Artificial Sequence
  Synthetic Polypeptide encoding a Bispecific T cell engager antibody
MALPVTALLLPLALLLHAARPDVVMTQTPLSLPVSLGDQASISCRSSQSLVHSNGNTYLRWYLQKPGQSPKVLIYKVSNRFSGVPDRFSGSGSGTDFTLKISRVEAEDLGVYFCSQSTHVPWTFGGGTKLEIKGGGGSGGGGSGGGGSEVKLDETGGGLVQPGRPMKLSCVASGFTFSDYWMNWVRQSPEKGLEWVAQIRNKPYNYETYYSDSVKGRFTISRDDSKSSVYLQMNNLRVEDMGIYYCTGSYYGMDYWGQGTSVTVSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7588 - protein, 585 aa, Artificial Sequence
  Synthetic Polypeptide encoding a Bispecific T cell engager antibody
MALPVTALLLPLALLLHAARPDVVMTQTPLSLPVSLGDQASISCRSSQSLVHSNGNTYLRWYLQKPGQSPKVLIYKVSNRVSGVPDRFSGSGSGTDFTLKINRVEAEDLGVYFCSQSTHVPWTFGGGTKLEIKSSADDAKKDAAKKDDAKKDDAKKDGGVKLDETGGGLVQPGGAMKLSCVTSGFTFGHYWMNWVRQSPEKGLEWVAQFRNKPYNYETYYSDSVKGRFTISRDDSKSSVYLQMNNLRVEDTGIYYCTGASYGMEYLGQGTSVTVSTTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7589 - protein, 581 aa, Artificial Sequence
  Synthetic Polypeptide encoding a Bispecific T cell engager antibody
MALPVTALLLPLALLLHAARPQVQLVESGGNLVQPGGSLRLSCAASGFTFGSFSMSWVRQAPGGGLEWVAGLSARSSLTHYADSVKGRFTISRDNAKNSVYLQMNSLRVEDTAVYYCARRSYDSSGYWGHFYSYMDVWGQGTLVTVSGGGGSGGGGSGGGGSSVLTQPSSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLGTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7590 - protein, 576 aa, Artificial Sequence
  Synthetic Polypeptide encoding a Bispecific T cell engager antibody
MALPVTALLLPLALLLHAARPDIQMTQSPSSLSASVGDRVTITCRTSQSLSSYTHWYQQKPGKAPKLLIYAASSRGSGVPSRFSGSGSGTDFTLTISSLQPEDFATYYCQQSRTFGQGTKVEIKGGGGSGGGGSGGGGSQVQLQQSGPGLVKPSQTLSLTCAISGDSVSSYNAVWNWIRQSPSRGLEWLGRTYYRSGWYNDYAESVKSRITINPDTSKNQFSLQLNSVTPEDTAVYYCARSGHITVFGVNVDAFDMWGQGTMVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7591 - protein, 575 aa, Artificial Sequence
  Synthetic Polypeptide encoding a Bispecific T cell engager antibody
MALPVTALLLPLALLLHAARPDIVLTQSPLSLAVSLGQPAIISCKASQSVSFAGTSLMHWYHQKPGQQPRLLIYRASNLEAGVPDRFSGSGSKTDFTLTISPVEAEDAATYYCQQSREYPYTFGGGTKLEIKRGGGGSGGGGSGGGGSQVQLVQSGAEVVKPGASVKISCKASGYTFTGYFMNWVKQSPGQSLEWIGRIHPYDGDTFYNQKFQGKATLTVDKSSNTAHMELLSLTSEDFAVYYCTRYDGSRAMDYWGQGTTVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7592 - protein, 548 aa, Artificial Sequence
  Synthetic Polypeptide encoding a Bispecific T cell engager antibody
MALPVTALLLPLALLLHAARPNSCELTNITIAIEKEECRFCISINTTWCAGYCYTRDLVYKDPARPKIQKTCTFKELVYETVRVPGCAHHADSLYTYPVATQCHCGKCDSDSTDCTVRGLGPSYCSFGEMKEGGGGSGGGGSGGGGSAPDVQDCPECTLQENPFFSQPGAPILQCMGCCFSRAYPTPLRSKKTMLVQKNVTSESTCCVAKSYNRVTVMGGFKVENHTACHCSTCYYHKSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7593 - protein, 579 aa, Artificial Sequence
  Synthetic Polypeptide encoding a Bispecific T cell engager antibody
MALPVTALLLPLALLLHAARPDLETTLTQSPATLSVSPGERVTLSCRASQSVGSNLAWYQQKFGQAPRLLIYDASTRATGIPARFSGSGSGTEFTLTISRLEPEDFAVYYCHQYGSSPRTFGQGTKVDIKRGGGGSGGGGSGGGGSQVQLVQSGAEVKKPGASVKVSCKASGYTFTTYGISWVRQAPGQGLEWMGWISAYNGHTNYAQMLQGRVTMTTDTSTSTAYMELRGLRSDDTAVYYCAREAYASYGSGSYWTDYWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7594 - protein, 572 aa, Artificial Sequence
  Synthetic Polypeptide encoding a Bispecific T cell engager antibody
MALPVTALLLPLALLLHAARPDDVVMTQTPLSLPVTPGEPASISCRSSQSLVHRNGNTYLHWYLQKPGQSPKLLIHKVSNRFSGVPDRFSGSGSGTDFTLKISRVEAEDLGVYFCSQSTHVPPLTFGAGTKLELKGGGGSGGGGSGGGGSEVQLVQSGAEVEKPGASVKISCKASGSSFTGYNMNWVRQNIGKSLEWIGAIDPYYGGTSYNQKFKGRATLTVDKSTSTAYMHLKSLRSEDTAVYYCVSGMEYWGQGTSVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7595 - protein, 570 aa, Artificial Sequence
  Synthetic Polypeptide encoding a Bispecific T cell engager antibody
MALPVTALLLPLALLLHAARPDEIVMTQTPATLSVSAGERVTITCKASQSVSNDVTWYQQKPGQAPRLLIYSASNRYSGVPARFSGSGYGTEFTFTISSVQSEDFAVYFCQQDYSSFGQGTKLEIKRGGGGSGGGGSGGGGSQVQLVESGPGVVQPGRSLRISCAVSGFSVTNYGVHWVRQPPGKGLEWLGVIWAGGITNYNSAFMSRLTISKDNSKNTVYLQMNSLRAEDTAMYYCASRGGHYGYALDYWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7596 - protein, 572 aa, Artificial Sequence
  Synthetic Polypeptide encoding a Bispecific T cell engager antibody
MALPVTALLLPLALLLHAARPDIQMTQTASSLPASLGDRVTISCSASQDISNYLNWYQQKPDGTVKLLIFYSSNLHSGVPSRFSGGGSGTDYSLTISNLEPEDIATYFCHQYSKLPWTFGGGTKLEIKRGGGGSGGGGSGGGGSEVTLVESGGDFVKPGGSLKVSCAASGFAFSHYAMSWVRQTPAKRLEWVAYISSGGSGTYYSDSVKGRFTISRDNAKNTLYLQMRSLRSEDSAMYFCTRVKLGTYYFDSWGQGTTLTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7597 - protein, 574 aa, Artificial Sequence
  Synthetic Polypeptide encoding a Bispecific T cell engager antibody
MALPVTALLLPLALLLHAARPQFVLTQSPSASAALGASAKLTCTLSSAHKTYTIDWYQQQKGKAPRYLIQVKSDGTYTKATGVPDRFSGSSSGADRYLIIPSVQADDEADYYCGTDYTGGYVFGGGTQLTVTGGGGSGGGGSGGGGSEQLKESGGGLFKPTDTLTLTCTVSGFSLSYYGVNWVRQAPGNGLEWIGTIGGSGDTYYASWAKSRSTIIRNTNENTVTLKMTSLTAADTATYFCVRYANIGYEYFNVWGPGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7598 - protein, 579 aa, Artificial Sequence
  Synthetic Polypeptide encoding a Bispecific T cell engager antibody
MALPVTALLLPLALLLHAARPQFVLTQSPSVSAALGASAKLTCTLSSAHKTYTIDWYQQQQGEAPRYLMQVKSDGSYTKGTGVPDRFSGSSSGADRYLIIPSVQADDEAGYVCGADDNGGYVFGGGTQLTVTGGGGSGGGGSGGGGSQSVKESEGGLFKPTDTLTLTCTVSGFSLSRHALTWVRQAPGNGLEWIGAIDNAGTTYYASWAKSRSTITRNTDLHTVTLKMTSLTASDTATYFCARVFYDINSGYYLDGMDLWGPGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7599 - protein, 573 aa, Artificial Sequence
  Synthetic Polypeptide encoding a Bispecific T cell engager antibody
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKGGGGSGGGGSGGGGSEVQLVESGGGLVQPGESLRLSCVASGFTFSRYKMNWVRQAPGKGLEWVSYISRSGRDIYYADSVKGRFTISRDNAKNSLYLQMNSLRDEDTAVYYCAGTVTTYYYFGMDVWGHGTTVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7600 - protein, 574 aa, Artificial Sequence
  Synthetic Polypeptide encoding a Bispecific T cell engager antibody
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKGGGGSGGGGSGGGGSEVQLVESGGGSVQPGESLRLSCVASGFTFSRYKMNWVRQAPGKGLEWVSYISRSGRDIYYADSVKGRFTISRDNAKNSLYLQMNSLRDEDTAVYYCAGTVTTYYYDFGMDVWGQGTTVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7601 - protein, 573 aa, Artificial Sequence
  Synthetic Polypeptide encoding a Bispecific T cell engager antibody
MALPVTALLLPLALLLHAARPQSVLTQPPSASGTPGQRVTISCSGSRSNVGGNYVFWYQQVPGATPKLLIYRSNQRPSGVPDRFAGSKSGSSASLAISGLRSEDEADYYCATWDDSLSGFVFGTGTKVTVLGGGGGSGGGGSGGGGSEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARGYGKAYDQWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7602 - protein, 572 aa, Artificial Sequence
  Synthetic Polypeptide encoding a Bispecific T cell engager antibody
MALPVTALLLPLALLLHAARPQSVVTQPPSMSAAPGQQVTISCSGGNSNIERNYVSWYLQLPGTAPKLVIFDNDRRPSGIPDRFSGSKSGTSATLGITGLQTGDEADYYCGTWDSSLRGWVFGGGTKLTVLGGGGGSGGGGSGGGGSEVQLVESGGGLIQPGGSLRLSCAASGFTFSNYAMNWVRQAPGKGLEWVSTINGRGSSTIYADSVKGRFTISRDNSKNTLYLQMNSLRAEDTATYYCARYISRGLGDSWGQGTLVTVTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7603 - protein, 572 aa, Artificial Sequence
  Synthetic Polypeptide encoding a Bispecific T cell engager antibody
MALPVTALLLPLALLLHAARPQSVVTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSYVFGTGTKLTVLGGGGGSGGGGSGGGGSEVQLVETGGNLVQPGASLRLSCAASGFSFSGTAMHWVRQAPGKGLEWVSTISSTGRSTYYRDSVKGRFTISRDNSKNTLYLQMNSLRGEDTAVYYCARVSFDYWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7604 - protein, 574 aa, Artificial Sequence
  Synthetic Polypeptide encoding a Bispecific T cell engager antibody
MALPVTALLLPLALLLHAARPQSVVTQPASVSGSPGQSITISCTGTSSDVGGYNYVSWYQQHPGKAPKLMIYDVSKRPSGVSNRFSGSKSGNTASLTISGLQAEDEADYYCSSYTSSSTLVFGGGTKLTVLGGGGGSGGGGSGGGGSEVQLVESGGAFVQPGGSLRLSCAASGFTFSSYAMTWVRQAPGKGLEWVSTISGRGRSTFYADSVKGRFTISRDNSKNTLYLQMNSLRAEDTAVYYCARYYHAGAFDLWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7605 - protein, 572 aa, Artificial Sequence
  Synthetic Polypeptide encoding a Bispecific T cell engager antibody
MALPVTALLLPLALLLHAARPDNIELTQSPAIMSASPGERVTMTCSASSSIRYIYWYQQKPGSSPRLLIYDTSNVAPGVPFRFSGSGSGTSYSLTINRMEAEDAATYYCQEWSGYPYTFGGGTKLDIKRGGGGSGGGGSGGGGSQVKLQESGGGLVKPGGSLKLSCAASGFTFSSYGMSWVRQTPDKRLEWVATISSGGSYTYYPDSVKGRFTISRDNAKNTLYLQMSSLKSEDTAMYYCARGNWEGWYFDVWGQGTTVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7606 - protein, 582 aa, Artificial Sequence
  Synthetic Polypeptide encoding a Bispecific T cell engager antibody
MALPVTALLLPLALLLHAARPDNFMLTQPHSVSESPGKTVTISCTGSGGSIDNNYVHWYQQRPGSAPTTVMFEDNQRPSGVPDRFSGSIDSSSNSASLVISGLKTEDEGDYYCQSSDGSKVVFGGGTKLTVLGQGGGGSGGGGSGGGGSEVQLVQSGGGSLTLSCAASGVVQPGRFTFSSYGMHWVRQAPGKGLEWVSVISYDGSNKYYADSVKGRFTISRDNSKNTLYLQMNSLRTEDTAVYYCAKTLSAGEWIGGGAFDIWGHGTMVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7607 - protein, 572 aa, Artificial Sequence
  Synthetic Polypeptide encoding a Bispecific T cell engager antibody
MALPVTALLLPLALLLHAARPDVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQNTPVPPKFGSGTKLEIKGGGGSGGGGSGGGGSQVQLQQSGAELVRPGASVKLSCKASGYTFNDYEMHWVKQTPVHGLKWIGALEPKTGDTAYSQKFKGKATLTADKSSSTAYMELRSLTSEDSAVYYCTSCYYYTYSGQGTLVTVSATRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7608 - protein, 571 aa, Artificial Sequence
  Synthetic Polypeptide encoding a Bispecific T cell engager antibody
MALPVTALLLPLALLLHAARPDIQLTQSPSSLSASVGDRVTITCRASQGIRNDLGWYQQKPGKAPKRLIYAASSLQNGVPSRFSGSGSGTEFTLTISSLQPEDFATYYCLQHNTYPAFGQGTKVEIKRGGGGSGGGGSGGGGSQVQLQESGPGLVKPSQTLSLTCTVSGGSISSFNYYWSWIRHHPGKGLEWIGYIYYSGSTYSNPSLKSRVTISVDTSKNQFSLTLSSVTAADTAVYYCARGYNWNYFDYWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7609 - protein, 573 aa, Artificial Sequence
  Synthetic Polypeptide encoding a Bispecific T cell engager antibody
MALPVTALLLPLALLLHAARPDDIVLTQSPASLAVSLGQSVTISCRASESVEYYGTSLMQWYQQKPGQPPKLLIYATSNVESGVPARFSGSGSGTDFSLNIHPVEEDDIAMYFCQQSRKLPSTFGGGTKLEIKGGGGSGGGGSGGGGSDVRLQESGPGQVKPSQTVSLTCSVTGYSITNGNHWWNWIRQVSGSKLEWIGYISSSGSTDSNPSLKSRISITRDTSKNQLFLQLNSVTTEDIATYYCARGYYFDYWGQGTTLTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7610 - protein, 451 aa, Artificial Sequence
  Synthetic Polypeptide encoding a Bispecific T cell engager antibody
MALPVTALLLPLALLLHAARPDEFEVQLVESGGGLVQAGGSLRLSCAASGITFSINTMGWYRQAPGKQRELVALISSIGDTYYADSVKGRFTISRDNAKNTVYLQMNSLKPEDTAVYYCKRFRTAAQGTDYWGQGTQVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7611 - protein, 386 aa, Artificial Sequence
  Synthetic Polypeptide encoding a Bispecific T cell engager antibody
MDWIWRILFLVGAATGAHSFEGSGFEYAKEMRNAYWEIALLPNLTNQQKRAPIRKLYDDPSQSSELLSEAKKLNDSQTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7612 - protein, 457 aa, Artificial Sequence
  Synthetic Polypeptide encoding a Bispecific T cell engager antibody
MALPVTALLLPLALLLHAARPDEFGSDLGIKLLFAAAKGQDDEVRILLAAGADVNAKDFEGYTPLHVAAYDGHLEIVEVLLKAGADVNAKDSQGRTPLHEAAYSGHLEIVEVLLKAGADVNAQDDAGETPADLAAAWGHEDIAEVLQKTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7613 - protein, 456 aa, Artificial Sequence
  Synthetic Polypeptide encoding a Bispecific T cell engager antibody
MDWIWRILFLVGAATGAHSFERSDLGKKLLEAARAGQDDEVRILMANGADVNAKDEYGLTPLYLATAHGHLEIVEVLLKNGADVNAVDAIGFTPLHLAAFIGHLEIAEVLLKHGADVNAQDKFGKTAFDISIGNGNEDLAEILQKLNTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7614 - protein, 608 aa, Artificial Sequence
  Synthetic Polypeptide encoding a Bispecific T cell engager antibody
MALPVTALLLPLALLLHAARPDEFEVQLVESGGGLVQAGGSLRLSCAASGITFSINTMGWYRQAPGKQRELVALISSIGDTYYADSVKGRFTISRDNAKNTVYLQMNSLKPEDTAVYYCKRFRTAAQGTDYWGQGTQVTVSSLEGGGGSGGGGSGGGGSGSGGSGSGGSGSGGSGSGGSFEVQLVESGGGLVQPGGSLRLSCAASGSIFGFNDMAWYRQAPGKQRELVALISRVGVTSSADSVKGRFTISRVNAKDTVYLQMNSLKPEDTAVYYCYMDQRLDGSTLAYWGQGTQVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7615 - protein, 572 aa, Artificial Sequence
  Synthetic Polypeptide encoding a Bispecific T cell engager antibody
MALPVTALLLPLALLLHAARPDIQMTQSPSSLSASVGDRVTITCRASQDVNTAVAWYQQKPGKAPKLLIYSASFLESGVPSRFSGSRSGTDFTLTISSLQPEDFATYYCQQHYTTPPTFGQTKVEIKRGGGGSGGGGSGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDVWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7616 - protein, 451 aa, Artificial Sequence
  Synthetic Polypeptide encoding a Bispecific T cell engager antibody
MALPVTALLLPLALLLHAARPDEFDVQLVESGGGLVQPGGSLRLSCAASGSIGGLNAMAWYRQAPGKERELVAGIFGVGSTRYADSVKGRFTISRDNSKNTVYLQMNSLRPEDTAVYYCRMSSVTRGSSDYWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7617 - protein, 391 aa, Artificial Sequence
  Synthetic Polypeptide encoding a Bispecific T cell engager antibody
MALPVTALLLPLALLLHAARPDEFVDNKFNKERYSAYYEIWQLPNLNVRQKAAFIGSLQDDPSQSANLLAEAKKLNDAQAPKTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7618 - protein, 613 aa, Artificial Sequence
  Synthetic Polypeptide encoding a Bispecific T cell engager antibody
MALPVTALLLPLALLLHAARPDEFDVQLVESGGGLVQPGGSLRLSCAASGSIGGLNAMAWYRQAPGKERELVAGIFGVGSTRYADSVKGRFTISRDNSKNTVYLQMNSLRPEDTAVYYCRMSSVTRGSSDYWGQGTLVTVSSLEGGGGSGGGGSGGGGSGSGGSGSGGSGSGGSGSGGSFEVQLVESGGSLVQPGGSLRLSCAASGFTFDDYAMSWVRQVPGKGLEWVSSINWSGTHTDYADSVKGRFTISRNNANNTLYLQMNSLKSEDTAVYYCAKNWRDAGTTWFEKSGSAGQGTQVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7619 - protein, 571 aa, Artificial Sequence
  Synthetic Polypeptide encoding a Bispecific T cell engager antibody
MALPVTALLLPLALLLHAARPDQSVLTQPPSVSVAPGKTARIPCEGNYIGSSNVHWYQQKPGQAPVLVIHFDSDRPSGIPDRFSGSNSGNMATLTISRVEAGDEADYYCQVWENHGWVFGGGTKLTVLSGGGGSGGGGSGGGGSEVQLVETGGGLVQPGESLRLSCAASGFTFSDYEMNWVRQAPGKGLEWVSYISSSGSTIYYADSVKGRFTIYRDNAKNSLYLQMNSLRAEDTALYYCARAWGVGPPDYWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7620 - protein, 579 aa, Artificial Sequence
  Synthetic Polypeptide encoding a Bispecific T cell engager antibody
MALPVTALLLPLALLLHAARPDIQMTQSPSSLSASVGDTVTITCQANGYLNWYQQRRGKAPKLLIYDGSKLERGVPSRFSGRRWGQEYNLTINNLQPEDIATYFCQVYEFVVPGTRLDLKRTVAAPGGGGSGGGGSGGGGSQVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVSSASTKGPTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7621 - protein, 585 aa, Artificial Sequence
  Synthetic Polypeptide encoding a Bispecific T cell engager antibody
MALPVTALLLPLALLLHAARPQSALTQPPSASGSPGQSITISCTGTSNNFVSWYQQHAGKAPKLVIYDVNKRPSGVPDRFSGSKSGNTASLTVSGLQTDDEAVYYCGSLVGNWDVIFGGGTKLTVLGGGGSGGGGSGGGGSQPQLQESGPTLVEASETLSLTCAVSGDSTAACNSFWGWVRQPPGKGLEWVGSLSHCASYWNRGWTYHNPSLKSRLTLALDTPKNLVFLKLNSVTAADTATYYCARFGGEVLRYTDWPKPAWVDLWGRGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7622 - protein, 570 aa, Artificial Sequence
  Synthetic Polypeptide encoding a Bispecific T cell engager antibody
MALPVTALLLPLALLLHAARPEIVLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIKRGGGGSGGGGSGGGGSQVQLVQSGGQMKKPGESMRISCRASGYEFIDCTLNWIRLAPGKRPEWMGWLKPRGGAVNYARPLQGRVTMTRDVYSDTAFLELRSLTVDDTAVYFCTRGKNCDYNWDFEHWGRGTPVIVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7623 - protein, 580 aa, Artificial Sequence
  Synthetic Polypeptide encoding a Bispecific T cell engager antibody
MALPVTALLLPLALLLHAARPELVLTQSPGTLSLSAGERATLSCRASQSVSSGSLAWYQQKPGQAPRLLIYGASTRATGIPDRFSGSGSGTDFTLTIGRLEPEDLAVYYCQQYGTSPYTFGQGTKLEIGGGGSGGGGSGGGGSLEQSGAEVKKPGSSVQVSCKASGGTFSMYGFNWVRQAPGHGLEWMGGIIPIFGTSNYAQKFRGRVTFTADQATSTAYMELTNLRSDDTAVYYCARDFGPDWEDGDSYDGSGRGFFDFWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7624 - protein, 576 aa, Artificial Sequence
  Synthetic Polypeptide encoding a Bispecific T cell engager antibody
MALPVTALLLPLALLLHAARPDVVMTQSPSSLSASVGDRVTITCQSSLDISHYLNWYQQKPGKAPKLLIYDASNLETGVPSRFSGSGSGTHFTFTISSLQPEDFATYYCQQYDNLPLTFGGGTKLEIKRGGGGSGGGGSGGGGSQVQLVQSGGGVVQPGGSLRVSCAASGVTLSDYGMHWVRQAPGKGLEWVAFIRNDGSDKYYADSVKGRFTISRDNSEKTVSLQMSSLRAEDTAVYYCAKNGESGPLDYWYLDLWGRGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7625 - protein, 576 aa, Artificial Sequence
  Synthetic Polypeptide encoding a Bispecific T cell engager antibody
MALPVTALLLPLALLLHAARPDDIVMTQSQDSMATSVGERVTVNCKASQNVDTNVAWYQQKPGQSPEPLLFSASYRYTGVPDRFSGSGSGTDFTLTISSVQAEDVAEYFCQQYNSYPLTFGQGTKLEIKRGGGGSGGGGSGGGGSEVQVEVSGGGLVQPGGSMRLSCAVSGFTFSNYWMNWVRQSPEKGLEWIAEIRLKSNNFARYYAESVKGRFTISRDNSKNSLYLQMISLRAEDTAIYYCTSYGNYVGHYFDHWGQGTLLTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7626 - protein, 580 aa, Artificial Sequence
  Synthetic Polypeptide encoding a Bispecific T cell engager antibody
MALPVTALLLPLALLLHAARPSYELTQPPSVSGTPGQRVAISCSGSSSNIGTRMVTWYQHVPGTAPKLLIFNNNQRPSGVPDRFSASKSGTSASLAIIGLQSDDEADYYCATWDDNVKSYVFGTGTKVTVLGSRGGGGSGGGGSGGGGSLEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARAPQSWYVGDVWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7627 - protein, 577 aa, Artificial Sequence
  Synthetic Polypeptide encoding a Bispecific T cell engager antibody
MALPVTALLLPLALLLHAARPQSVLTQPPSLSVAPGKTASITCGGNNIGMKSVHWYQQRPGQAPVLVIYYDSDRPSGIPGRFSGSNSGNTATLTISRVEAGDEADYYCQVWDTTGDHPGYVFGTGTKVTVLGGGGSGGGGSGGGGSQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGVYGYSGSAPYDEWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7628 - protein, 583 aa, Artificial Sequence
  Synthetic Polypeptide encoding a Bispecific T cell engager antibody
MALPVTALLLPLALLLHAARPDEIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPRTFGQGTKVEIKRGGGGSGGGGSGGGGSQVQLVQSGGGVVQPGRSLRLSCAASGFTFSSYGMHWVRQAPGKGLEWVAVISYDGSNKYYADSVKGRFTISRDNSKNTLYLQMNSLRAEDTAVYYCARDFDYGDSYYYYGMDVWGQGTTVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7629 - protein, 577 aa, Artificial Sequence
  Synthetic Polypeptide encoding a Bispecific T cell engager antibody
MALPVTALLLPLALLLHAARPDEIVLTQSPATLSLSPGERATLSCRASQSVGSYLAWYQQKPGAPRLLIYDASHRATGIPARFSGSGSGTDFTLTISSLEPEDFAVYYCQQRSNWPPMYTFGQGTKLEIKRGGGGSGGGGSGGGGSEVQLVQSGAEVSVKVSCKASGGKKPGSTFSSYTISWVRQAPGQGLEWMGGIIPIFGTANYAQKFQGRVTITADKSTSTAYMELSSLRSEDTAVYYCAGDTDSSGYYGAVDYWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7630 - protein, 560 aa, Artificial Sequence
  Synthetic Polypeptide encoding a Bispecific T cell engager antibody
MALPVTALLLPLALLLHAARPDIQMTQSPSSLSASVGDRVTITCQASQDINNYLNWYQQKPGKAPKLLIYDASNLQTGVPSRFSGSGSGTDFTFTIEDIATYYCQQYTFGPGTKVDIKGGGGSGGGGSGGGGSEVQLLESGGGLVQPGGSLRLSCAASGFTFSWYSMTWVRQAPGKGLEWVSSIVPWGDFTQYADSVKGRFTISRDNSKNTLYLQMNSLRAEDTAVYYCAKGPGWGSFDLWGRGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7631 - protein, 449 aa, Artificial Sequence
  Synthetic Polypeptide encoding a Bispecific T cell engager antibody
MDWIWRILFLVGAATGAHSEVQLVESGGGLVQPGGSLRLSCAASGSVFKINVMAWYRQAPGKGRELVAGIISGGSTSYADSVKGRFTISRDNAKNTLYLQMNSLRPEDTAVYYCAFITTESDYDLGRRYWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7632 - protein, 570 aa, Artificial Sequence
  Synthetic Polypeptide encoding a Bispecific T cell engager antibody
MALPVTALLLPLALLLHAARPDIQMTQSPSSLSASVGDRVTITCTASLSVSSTYLHWYQQKPGSSPKLWIYSTSNLASGVPSRFSGSGSGTSYTLTISSLQPEDFATYYCHQYHRSPLTFGGGTKVEIKRGGGGSGGGGSGGGGSEVQLVESGGGLVQPGGSLRLSCAASGFSLTKYGVHWVRQAPGKGLEWVGVKWAGGSTDYNSALMSRFTISKDNAKNSLYLQMNSLRAEDTAVYYCARDHRDAMDYWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7633 - protein, 574 aa, Artificial Sequence
  Synthetic Polypeptide encoding a Bispecific T cell engager antibody
MALPVTALLLPLALLLHAARPDIQMTQSPSSLSASVGDRVTITCKASQDVGTAVAWYQQKPGKAPKLLIYSASYRSTGVPSRFSGSGSGTDFTLTISSLQPEDFATYYCQHHYSAPWTFGGGTKVEIKGGGGSGGGGSGGGGSEVQLVESGGGLVQPGGSLRLSCAASGFTFSRNGMSWVRQAPGKGLEWVATVSSGGSYIYYADSVKGRFTISRDNAKNSLYLQMNSLRAEDTAVYYCARQGTTALATRFFDVWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7634 - protein, 580 aa, Artificial Sequence
  Synthetic Polypeptide encoding a Bispecific T cell engager antibody
MALPVTALLLPLALLLHAARPDIVMTQSPSSLTMSVGQKVTMSCKSSHSLLNSRNQKNYLAWFQQKPGQSPKLLVYFASTRESGVPDRFIGSGSGTDFTLTISNVQAEDLADYFCQQHYTTLPTFGGGTKLEIKGGGGSGGGGSGGGGSQIQLVQSGPDLKKPGETVKISCKASGYTFTNTGMNWVKQAPGKGLKWMGWINTYTGEPTYADDFKGRFTFSLETSASTAYLQINNLKNEDTATYFCTRWGYGSSLYYAMDYWGQGTSVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7635 - protein, 570 aa, Artificial Sequence
  Synthetic Polypeptide encoding a Bispecific T cell engager antibody
MALPVTALLLPLALLLHAARPDIQMTQSPPSLSASVGGKVTITCKASQDIDRYMAWYQDKPGKGPKLLIHDTSTLQPGIPSRFSGSGSGRDYSFSISNLEPEDIATYYCLQYDNLWTFGGGTKLEIKRGGGGSGGGGSGGGGSQVQLVQSGAELVKPGASVKMSCKASGYIFTNYNIHWVKKSPGQGLEWIGAIYPGNGDAPYSQKFQDRATLTADTSSSTTYMELSSLTSEDSAVYYCVRANWDVAFAYWGQGTLVSVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7636 - protein, 571 aa, Artificial Sequence
  Synthetic Polypeptide encoding a Bispecific T cell engager antibody
MALPVTALLLPLALLLHAARPDIQMTQSPASLSASVGETVTITCRVSGNIHNYLAWYQQKQGKSPQLLVYNAKTLADGVPSRFSGSGSGTQYSLKINSLQPEDFGSYYCQHFWSNPYTFGGGTKLEIKGGGGSGGGGSGGGGSQVQLQQSGASVKVSCKASELVRPGTGYAFTNYLIEWVKQRPGQGLEWIGVINPGSGGTNYNEKFKGKATLTADKSSSTAYMQLSSLTSDDSAVYFCARYRSYDWYFDVWGAGTTVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7637 - protein, 576 aa, Artificial Sequence
  Synthetic Polypeptide encoding a Bispecific T cell engager antibody
MALPVTALLLPLALLLHAARPDDIQMTQSPSSLSASVGDRVTITCRSSQRIVHSNGNTYLEWYQQTPGKAPKLLIYKVSNRFSGVPSRFSGSGSGTDYTPTISSLQPEDIATYYCFQGSHVPPTFGQGTKLQITGGGGSGGGGSGGGGSEVQLVESGGGVVQPGRSLRLSCSSSGPTFSDYYMYWVRQAPGKGLEWVAYMSNVGAITDYPDTVKGRPTISRDNSKNTLFLMDSLRPEDTGVYFCARGTRDGSWFAYWGQGTPVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7638 - protein, 570 aa, Artificial Sequence
  Synthetic Polypeptide encoding a Bispecific T cell engager antibody
MALPVTALLLPLALLLHAARPDIQMTQSFSSLSASVGDRVTITCRASQDISNYLNWYQQKPGKAPKLLIYYTSRLHSGVPSRFSGSGSGTDYTLTISSLQPEDFATYFCQQGNTLPWTFGGGTKLEIKRGGGGSGGGGSGGGGSEVQLVQSGGGLVQSGGSLRLSCRASGYTFTRYWMLWVRQRPGKGLEWVAEINPRNDRTNYNEKFKTRFTISVDRSKNTLYLQMDSLRAEDTAVYFCALGGGYAMDYWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7639 - protein, 557 aa, Artificial Sequence
  Synthetic Polypeptide encoding a Bispecific T cell engager antibody
MEMLQGLLLLLLLSMGGAWASREPLRPWCHPINAILAVEKEGCPVCITVNTTICAGYCPTMMRVLQAVLPPLPQVVCTYRDVRFESIRLPGCPRGVDPVVSFPVALSCRCGPCRRSTSDCGGPKDHPLTCDHPQLSGLLFLGGGGSGGGGSGGGGSAPDVQDCPECTLQENPFFSQPGAPILQCMGCCFSRAYPTPLRSKKTMLVQKNVTSESTCCVAKSYNRVTVMGGFKVENHTACHCSTCYYHKSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7640 - protein, 571 aa, Artificial Sequence
  Synthetic Polypeptide encoding a Bispecific T cell engager antibody
MALPVTALLLPLALLLHAARPDIQMTQSPASLSASVGETVTIICRASVNIYSYLAWYQQKQGKSPQLLVYNAKILAEGVPSRFSGSGSGTQFSLKINSLQPEDFGSYYCQHHYGTFTFGSGTKLEIKRGGGGSGGGGSGGGGSQVQLKESGPGLVAPSQSLSITCTISGFSLTSYGVHWVRQPPGKGLEWLVVIWSDGSTTYNSALKSRLSISKDNSKSQVFLKMNSLQTDDTAIYYCASHYGSTLAFASWGHGTLVTVSAATRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7641 - protein, 579 aa, Artificial Sequence
  Synthetic Polypeptide encoding a Bispecific T cell engager antibody
MALPVTALLLPLALLLHAARPDIVMTQSHKFMSTSVGDRVSVTCKASQNVGNNVAWYQQKPGQSPKVLIYSASYRYSGVPDRFTGSGSGTDFTLTISNVQSEDLAEYFCQQYNTYPFTFGSGTKLEIKGGGGSGGGGSGGGGSEVQLEESGGGLVQPGGSMKLSCVASGFTFSNYWMNWVRQSPEKGLEWVAEIRFKSHNYATHFAESVKGRFTISRDDSKSSVYLQMNNLRAEDTGIYYCTRRIGNSDYDWWYFDVWGAGTSVTVSSASTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7642 - protein, 575 aa, Artificial Sequence; identical to SEQ ID NO: 7527
  Synthetic Polypeptide encoding a Bispecific T cell engager antibody

SEQ ID NO: 7643 - protein, 581 aa, Artificial Sequence
  Synthetic Polypeptide encoding a Bispecific T cell engager antibody
MALPVTALLLPLALLLHAARPDQSVLTQPPSVSGAPGQRVTISCTGSSSNIGAGYDVHWYQQLPGTAPKLLIYGNSNRPSGVPDRFSGSKSGTSASLAITGLQAEDEADYYCQSYDNSLSSWVFGGGTKLTVLGQPKGGGGSGGGGSGGGGSEVQLQQSGAEVKKPGSSVKVSCKASGGTFSSYAISWVRQAPGQGLEWMGRIIPILGIANYAQKFQGRVTITADKSTSTAYMELSSLRSEDTAVYYCARDVGSGSYSLDYWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7644 - protein, 578 aa, Artificial Sequence
  Synthetic Polypeptide encoding a Bispecific T cell engager antibody
MALPVTALLLPLALLLHAARPDQSVVTQPPSVSAAPGRKVTISCSGSSSNIGSNYVSWYQQVPGTAPKLLIYEDDKRPSGIPDRFSGSKSGTSATLGITGLQTGDEADYFCATWDRTVNVVRFGGGTRLTVHSQPKGGGGSGGGGSGGGGSQLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARHVGHELDYWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7645 - protein, 572 aa, Artificial Sequence
  Synthetic Polypeptide encoding a Bispecific T cell engager antibody
MALPVTALLLPLALLLHAARPDIQMTQSPSSLSASVGDRVTITCRASQSISSYLNWYQQKPGKAPKLLIYAASSLQSGVPSGFSGSGSGTDFTLTISSLQPEDFATYYCQQSYSTPLTFGGGTKVEIKRGGGGSGGGGSGGGGSQVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCAREGKNGAFDIWGQGTMVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7646 - protein, 458 aa, Artificial Sequence
  Synthetic Polypeptide encoding a Bispecific T cell engager antibody
MALPVTALLLPLALLLHAARPDEFDVQLVESGGGLVQPGGSLRLSCAASGFILDYYAIGWFRQAPGKEREGVLCIDASDDITYYADSVKGRFTISRDNSKNTVYLQMNSLRPEDTAVYYCATPIGLSSSCLLEYDYDYWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7647 - protein, 621 aa, Artificial Sequence
  Synthetic Polypeptide encoding a Bispecific T cell engager antibody
MALPVTALLLPLALLLHAARPDEFDVQLVESGGGLVQPGGSLRLSCAASGFILDYYAIGWFRQAPGKEREGVLCIDASDDITYYADSVKGRFTISRDNSKNTVYLQMNSLRPEDTAVYYCATPIGLSSSCLLEYDYDYWGQGTLVTVSSLEGGSGSGGGGSGGGGSGSGGSGSGGSGSGGSGSGGSFEVQLVESGGGLVQPGGSLRLSCAASGRTYYLNAMGWFRQAPGKEREFVAAIDWSEGNKDYADSVKGRFTISRDNSKNTVYLQMNSLRPEDTAVYYCAADTPPWGPLIYIESYDSWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7648 - protein, 572 aa, Artificial Sequence
  Synthetic Polypeptide encoding a Bispecific T cell engager antibody
MALPVTALLLPLALLLHAARPDQIVLTQSPAIMSASPGEKVTISCSASSSVSYMYWYQQKPGSSPKPWIYRTSNLASGVPARFSGSGSGTSYSLTISNMEAEDAAAYYCQQYHSYPTTFGGGTKLEVKGGGGSGGGGSGGGGSEVQLVESGGGLVQPKGSLKLSCAASGFSFNTYAMNWVRQAPGKGLEWIAHIRSKSNNFATYYADSVKDRFSISRDASENILFLQMNNLKTEDTAMYYCVRQGGDFPMDYWGQGTSVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7649 - protein, 571 aa, Artificial Sequence
  Synthetic Polypeptide encoding a Bispecific T cell engager antibody
MALPVTALLLPLALLLHAARPDDIQMTQSSSSFSVSLGDRVTITCMASEDIYIRLAWYQQKPGNAPRLLISAATSLETGVPSRFSGSGSGKDYTLSITSLQTEDVGTYYCQQYWSSPWTFGGGTKLEINGGGGSGGGGSGGGGSDVQLQESGPGLVKPSQSLSLTCTVTGYSITSDYTWNWIRQFPGNKLEWMGYITYSGSTSYNPSLKSRNSITRDTSKNQFFLQLNSVTTEDTATYYCARLGRRYTMDYWGQGTSVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7650 - protein, 570 aa, Artificial Sequence
  Synthetic Polypeptide encoding a Bispecific T cell engager antibody
MALPVTALLLPLALLLHAARPDVQLQESGPGLVKPSQSLSLTCTVTGYSITSDYTWNWIRQFPGNKLEWMGYITYSGSTSYNPSLKSRNSITRDTSKNQFFLQLNSVTTEDTATYYCARLGRRYTMDYWGQGTSVTVSSGGGGSGGGGSGGGGSDIQMTQSSSSFSVSLGDRVTITCMASEDIYIRLAWYQQKPGNAPRLLISAATSLETGVPSRFSGSGSGKDYTLSITSLQTEDVGTYYCQQYWSSPWTFGGGTKLEINTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7651 - protein, 571 aa, Artificial Sequence
  Synthetic Polypeptide encoding a Bispecific T cell engager antibody
MALPVTALLLPLALLLHAARPDIQMTQSSSSFSVSLGDRVTITCKASEDIYIRLAWYQQKPGNAPRLLISAATSLETGIPSRFSGSGSGEDYTLTITSLQTEDVATYYCQQYWTTPWTFGGGTKLEIKRGGGGSGGGGSGGGGSDVQLQESGPGLVKPSQSLSLTCTVTGYSITIDYTWNWIRQFPGNKLEWMGYITYSGSTDYNPSLKSRSSITRDTSMNQFFLQLNSVTTEDTATYYCARLGRRYALDYWGQGTSVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7652 - protein, 572 aa, Artificial Sequence
  Synthetic Polypeptide encoding a Bispecific T cell engager antibody
MALPVTALLLPLALLLHAARPDIVMTQAAPSIPVTPGESVSISCRSDKSLLHSNGNTYLFWFLQRPGQSPQLLIYRMSNLASGVPDRFSGSGSGTAFTLRISGVEAEDVGVYYCMQHLEYPYTFGGGTKLEIKGGGGSGGGGSGGGGSQVQLQQSGPELVKPGASVKMSCKASGYAFSSSWLNWVRQRPGKGLEWIGRIYPGDGENHYNGKFKGKATLTADKSSSTGYMQLSSLTSEDSAVYFCASYYEGGYWGQGTLITVSATRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7653 - protein, 571 aa, Artificial Sequence
  Synthetic Polypeptide encoding a Bispecific T cell engager antibody
MALPVTALLLPLALLLHAARPDIVLTQSPASLAVSLGQSVTISCRASESVEYYGTSLMQWYQQKPGQPPKLLIYGASNVESGVPARFSGSGSGTDFSLNIHPVEEDDIAMYFCQQSRKVPWTFGGGTKLEIKGGGGSGGGGSGGGGSEVKLVESGGGLVKPGGSRKLSCAASGFTFSSYTMSWVRQTPAKRLEWVATISSGSSTIYYADTVKGRFTISRDNAKNTLFLQMTSLRSEDTAMYYCARRWFLDCWGQGTTLTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7654 - protein, 574 aa, Artificial Sequence
  Synthetic Polypeptide encoding a Bispecific T cell engager antibody
MALPVTALLLPLALLLHAARPDQVQLQQSGPGLVKPSETLSLTCTVSGDSISSYYWSWIRQPPGKGLEWIGYIYYSGSTNYNPSLKSRVTISVDTSKSQFSLKLSSVTAADTAVYYCARGRYFDVWGRGTMVTSSGGGGSGGGGSGGGGSSSYVLTQPPSVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLGAAATRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7655 - protein, 575 aa, Artificial Sequence
  Synthetic Polypeptide encoding a Bispecific T cell engager antibody
MALPVTALLLPLALLLHAARPDIVMTQSPLSLPVTPGEPASISCRSSKSLLHSNGNTYLYWFQQKPGQAPRLLIYRMSNLASGVPDRFSGSGSGTAFTLKISRVEAEDVGVYYCMQHIEYPFTFGQGTKLEIKGGGGSGGGGSGGGGSQVQLVQSGPEVKKPGASVKVSCKASGYTFTNSWMNWVRQRPGKGLEWIGRIYPGDGETIYNGKFRVRVTITADESTSTAYMELSSLRSEDTAVYYCARGYDDYSFAYWGQGTTVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7656 - protein, 575 aa, Artificial Sequence
  Synthetic Polypeptide encoding a Bispecific T cell engager antibody
MALPVTALLLPLALLLHAARPDEIVMTQSPATLSLSPGERATLSCRASQSVSSYLAWYQQKPGQAPRLLIYDASNRATGIPARFSGSGSGTDFTLTISSLEPEDFAVYYCHQYGSSPQTFGQGTKVEIKRGGGGSGGGGSGGGGSEVQLVQSGAEVKKPGSSVKVSCKASGGTFSSYAISWVRQAPGQGLEWMGGIIPIFGTANYAQKFQGRVTITADESTSTAYMELSSLRSEDTAVYYCAVHYGDYVFSSMDVWGQGTTVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7657 - protein, 578 aa, Artificial Sequence
  Synthetic Polypeptide encoding a Bispecific T cell engager antibody
MALPVTALLLPLALLLHAARPDETTLTQSPGTLSLSPGERATLSCRASQSVSSSYLAWYQQKPGQAPRLLIYGASSRATGIPDRFSGSGSGTDFTLTISRLEPEDFAVYYCQQYGSSPRTFGQGTKVEIKRGGGGSGGGGSGGGGSEVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGPEYCINGVCSLDVWGQGTTVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7658 - protein, 580 aa, Artificial Sequence
  Synthetic Polypeptide encoding a Bispecific T cell engager antibody
MALPVTALLLPLALLLHAARPDIELTQSPSSLAVSAGEKVTMSCKSSQSLLNSRTRKNQLAWYQQKPGQSPELLIYWASTRQSGVPDRFTGSGSGTDFTLTISSVQAEDLAVYYCQQSYNLLTFGPGTKLEVKRGGGGSGGGGSGGGGSVKLQESGGGFVKPGGSLKVSCAASGFTFSSYAMSWVRLSPEMRLEWVATISSAGGYIFYSDSVQGRFTISRDNAKNTLHLQMGSLRSGDTAMYYCARQGFGNYGDYYAMDYWGQGTTVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7659 - protein, 579 aa, Artificial Sequence
  Synthetic Polypeptide encoding a Bispecific T cell engager antibody
MALPVTALLLPLALLLHAARPDIQMTQSPSSLSASVGDRVTITCRSSQNIVHSNGNTYLDWYQQTPGKAPKLLIYKVSNRFSGVPSRFSGSGSGTDFTFTISSLQPEDIATYYCFQYSHVPWTFGQGTKLQIGGGGSGGGGSGGGGSQVQLQQSGAEVKKPGSSVKVSCKASGYTFTNYYIYWVRQAPGQGLEWIGGINPTSGGSNFNEKFKTRVTITADESSTTAYMELSSLRSEDTAFYFCTRQGLWFDSDGRGFDFWGQGTTVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7660 - protein, 475 aa, Artificial Sequence
  Synthetic Polypeptide encoding a Bispecific T cell engager antibody
MALPVTALLLPLALLLHAARPLFNQEVQIPLTESYCGPCPKNWICYKNNCYQFFDESKNWYESQASCMSQNASLLKVYSKEDQDLLKLVKSYHWMGLVHIPTNGSWQWEDGSILSPNLLTIIEMQKGDCALYASSFKGYIENCSTPNTYICMQRTVGGGGSGGGGDTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7661 - protein, 569 aa, Artificial Sequence
  Synthetic Polypeptide encoding a Bispecific T cell engager antibody
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIKRGGGGSGGGGSGGGGSQVHLQESGPGLVKPSETLSLTCTVSDDSISSYYWSWIRQPPGKGLEWIGHISYSGSANYNPSLKSRVTISVDTSKNQFSLKLSSVTAADTAVYYCANWDDAFNIWGQGTMVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7662 - protein, 571 aa, Artificial Sequence
  Synthetic Polypeptide encoding a Bispecific T cell engager antibody
MALPVTALLLPLALLLHAARPDVVMTQTPLTLSVTIGQPASISCKSSQSLLDSDGKTYLHWLLQRPGQSPKRLIFLVSKLDSGVPDRFTGSGSGTDFTLKISRVEAEDLGVYYCWQGTHFPQTFGGGTKLEIKGGGGSGGGGSGGGGSVQLQESGPDLVKPSQSLSLTCTVTGYSITSGYSWHWIRQFPGNKLEWMGYIHYSGDTDYNPSLKSRFSITRDTSKNQFFLQLNSVTTEDTATYYCATPGGFVYWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7663 - protein, 575 aa, Artificial Sequence
  Synthetic Polypeptide encoding a Bispecific T cell engager antibody
MALPVTALLLPLALLLHAARPDQSELTQPRSVSGSPGQSVTISCTGTERDVGGYNYVSWYQQHPGKAPKLIIHDVIERSSGVPDRFSGSKSGNTASLTISGLQAEDEADYYCWSFAGGYYVFGTGTDVTVLGGGGSGGGGSGGGGSFEVQLLESGGGLVQPGGSLRLSCAASGFTFSTYQMSWVRQAPGKGLEWVSGIVSSGGSTAYADSVKGRFTISRDNSKNTLYLQMNSLRAEDTAVYYCAGELLPYYGMDVWGQGTTVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7664 - protein, 574 aa, Artificial Sequence
  Synthetic Polypeptide encoding a Bispecific T cell engager antibody
MALPVTALLLPLALLLHAARPDQSELTQPRSVSGSPGQSVTISCTGTERDVGGYNYVSWYQQHPGKAPKLIIHDVIERSSGVPDRFSGSKSGNTASLTISGLQAEDEADYYCWSFAGGYYVFGTGTDVTVLGGGGSGGGGSGGGGSEVQLLESGGGLVQPGGSLRLSCAASGFTFSTYEMHWVRQAPGKGLEWVSVILSSGGETNYADSVKGRFTISRDNSKNTLYLQMNSLRAEDTAVYYCAGMLLPYYGMDVWGQGTTVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7665 - protein, 476 aa, Artificial Sequence
  Synthetic Polypeptide encoding a Bispecific T cell engager antibody
MALPVTALLLPLALLLHAARPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7666 - protein, 571 aa, Artificial Sequence
  Synthetic Polypeptide encoding a Bispecific T cell engager antibody
MALPVTALLLPLALLLHAARPDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRGGGGSGGGGSGGGGSEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7667 - protein, 572 aa, Artificial Sequence
  Synthetic Polypeptide encoding a Bispecific T cell engager antibody
MALPVTALLLPLALLLHAARPAIVMTQTPSPVSAAVGGTVTINCQASESVYSNNYLSWFQQKPGQPPKLLIYLASTLASGVPSRFKGSGSGTQFTLTISGVQCDDAATYYCIGGKSSSTDGNAFGGGTEVVVRGGGGSGGGGSGGGGSQSLEESGGRLVKPDETLTITCTVSGIDLSSNGLTWVRQAPGEGLEWIGTINKDASAYYASWAKGRLTISKPSSTKVDLKITSPTTEDTATYFCGRIAFKTGTSIWGPGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7668 - protein, 570 aa, Artificial Sequence
  Synthetic Polypeptide encoding a Bispecific T cell engager antibody
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSGGGGSGGGGSQVQLVQSGAEVKKPGASVKVSCKASGYTFTSYDVHWVRQAPGQRLEWMGWLHADTGITKFSQKFQGRVTITRDTSASTAYMELSSLRSEDTAVYYCARERIQLWFDYWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7669 - protein, 589 aa, Artificial Sequence
  Synthetic Polypeptide encoding a Bispecific T cell engager antibody
MALPVTALLLPLALLLHAARPDDIVMTQSPLSLPVTPGEPASISCRSSQSLLHSNGYNYLVWYLQKPGQSPQLLIYLGSIRASGVPDRFSGSGSGTDFTLKISRVEAEDVGVYYCMQPLQTPITFGQGTRLEIKRGGGGSGGGGSGGGGSGLQCVAAPRWVLSQVQLQQWGAGLLKPSETLSLTCAVYGGSFSGNYWSWIRQPPGKGLEWIGEINHSGSTNYNPSLKSRVTISVDTSKNQFSLKLSSVTAADTAVYYCARGGSYNYFDYWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7670 - protein, 586 aa, Artificial Sequence
  Synthetic Polypeptide encoding a Bispecific T cell engager antibody
MALPVTALLLPLALLLHAARPDQLTQSPSSVSASVGDRVTITCRASRGISSWLAWYQQKPGKAPKLLIYTASSLQSGVPSRFSGSGSGTDFTLTISSLQPEDFATYYCQQAYSFPRTFGQGTKVEIKRGGGGSGGGGSGGGGSVAAPRWVLSQVQLQESGPGLVKPSQTLSLTCTVSGGSISSGGYYWIWIRQHPGKGLEWIGYIYYNGNTYYNPSLKSRVTMSVDTSKNQFSLKLSSVTAADTAVYYCARDGITMIRGYYYGMDVWGQGTTVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7671 - protein, 560 aa, Artificial Sequence
  Synthetic Polypeptide encoding a Bispecific T cell engager antibody
MALPVTALLLPLALLLHAARPDIVVTQSPASLAVSLGQRATISYRASKSVSTSGYSYMHWNQQKPGQPPRLLIYLVSNLESGVPARFSGSGSGTDFTLNIHPVEEEDAATYYCQHIRELTRSEGGPSWKGGGGSGGGGSGGGGSEVKLEESGGDLVKPGGSLKLSCAASGFTFSGYGMSWVRQTPDKRLEWVATISSGGSYTYYPDSVKGRFTISRDNAKNTLYLQMSSLKSEDTAMYYCARHEGGYYGSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7672 - protein, 576 aa, Artificial Sequence
  Synthetic Polypeptide encoding a Bispecific T cell engager antibody
MALPVTALLLPLALLLHAARPDDIQMTQSPSSLSASVGDRVTITCRASQGISNYLAWYQQKTGKVPKFLIYEASTLQSGVPSRFSGGGSGTDFTLTISSLQPEDVATYYCQNYNSAPFTFGPGTKVDIKGGGGSGGGGSGGGGSQVQLVESGGGVVQPGRSLRLSCAASGFAFSRYGMHWVRQAPGKGLEWVAVIWYDGSNKYYADSVKGRFTISRDNSKNTQYLQMNSLRAEDTAVYYCARGGDFLYYYYYGMDVWGQGTTVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7673 - protein, 567 aa, Artificial Sequence
  Synthetic Polypeptide encoding a Bispecific T cell engager antibody
MALPVTALLLPLALLLHAARPDIQMTQSPSSLSTSVGDRVTLTCKASQDVGTAVDWYQQKPGPSPKLLIYWASTRHTGIPSRFSGSGSGTDFTLTISSLQPEDFADYYCQQYNSYPLTFGPGTKVDIKGGGGSGGGGSGGGGSEVQLVQSGPEVKKPGATVKISCKTSGYTFTEYTIHWVKQAPGKGLEWIGNINPNNGGTTYNQKFEDKATLTVDKSTDTAYMELSSLRSEDTAVYYCAAGWNFDYWGQGTLLTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7674 - protein, 568 aa, Artificial Sequence
  Synthetic Polypeptide encoding a Bispecific T cell engager antibody
MALPVTALLLPLALLLHAARPDIQMTQSPSSLSASVGDRVTITCKASQDIYPYLNWFQQKPGKAPKTLIYRTNRLLDGVPSRFSGSGSGTDFTFTISSLQPYYCLQYDEFPLTFGAGTKLEIKRGGGGSGGGGSGGGGSQITLKESGPTLVKPTQTLTLTCTFSGFSLSTSNMGVGWIRQPPGKALEWLAHIWWDDDKYYSPSLKSRLTITKDTSKNQVVLTMTNMDPVDTATYYCVRSNYGYAWFAYWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7675 - protein, 568 aa, Artificial Sequence
  Synthetic Polypeptide encoding a Bispecific T cell engager antibody
MALPVTALLLPLALLLHAARPDIVMTQSQKFMSTSVGDRVNVTCKASQNVGTNVVWYQQKTGQSPKALIHSASYRYSGVPDRFTGSGSGTDFTLTLSNVQSEDLAEYFCQHYNSFPYTFGGGTKLEIKRGGGGSGGGGSGGGGSQVQLQQSGAELVRPGVSVKISCKGSGYRFTDYPIHWVKQSHAKSLEWIGIISTYYGDVTNNPKFRGKATMTVDKSSTTAYMELARLTSEDSAIYYCARNDLFAYWGQGTLVTVSATRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7676 - protein, 571 aa, Artificial Sequence
  Synthetic Polypeptide encoding a Bispecific T cell engager antibody
MALPVTALLLPLALLLHAARPDIKMTQSPSSMYASLGERVTITCKASPDINSYLSWFQQKPGKSPKTLIYRANRLVDGVPSRFSGGGSGQDYSLTINSLEYEDMGIYYCLQYDEFPYTFGGGTKLEMKGGGGSGGGGSGGGGSEVKLVESGGGLVKPGGSLKLSCAASGFTFSSYAMSWVRQIPEKRLEWVASISRGGTTYYPDSVKGRFTISRDNVRNILYLQMSSLRSEDTAMYYCGRYDYDGYYAMDYWGQGTSVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7677 - protein, 574 aa, Artificial Sequence
  Synthetic Polypeptide encoding a Bispecific T cell engager antibody
MALPVTALLLPLALLLHAARPDDVVVTPVSCFLSCISGAEGHHLIQGQQKCQYIWLLYALEPTETRTATQTPHLSCIQPRIWGPCQVQWQWVWDRLHPQHPSCGGGGCCNLLLSAHGAYTFGGGTRLELKGGGGSGGGGSGGGGSEVKLQESGPELVKPGASVKMSCKASGYTFTSYVMHWVKQKPGQGLEWIGYINPYNDGTKYNEKFKGKATLTSDKSSSTAYMELSSLTSEDSAVYYCARWKIYYGNYEDYWGQGTPLTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7678 - protein, 604 aa, Artificial Sequence
  Synthetic Polypeptide encoding a Bispecific T cell engager antibody
MALPVTALLLPLALLLHAARPDEFQVQLVQSGGGLVQPGGSLRLSCAASDFDFAAYEMSWVRQAPGQGLEWVAIISHDGIDKYYTDSVKGRFTISRDNSKNTLYLQMNTLRAEDTATYYCLRLGAVGQGTLVTVSSLEGGGGSGGGGSGGGGSGSGGSGSGGSGSGGSGSGGSFEQVQLVQSGGGLVQPGGSLRLSCAASDFAFDDYEMSWVRQAPGKALEWIGDINHSGTTIYNPSLKSRVTISRDNSKNTLYLQMNTLRAEDTAIYYCARPHYGDYSDAFDIWGQGTMVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7679 - protein, 579 aa, Artificial Sequence
  Synthetic Polypeptide encoding a Bispecific T cell engager antibody
MALPVTALLLPLALLLHAARPEIVMTQSPATLSVSPGERATLSCRASQSVSSNLAWYQQKPGQAPRLLIYGASTRATGIPARFSGSGSGTDFTLTISSLQSVDSAVYYCQQYNNWPPYTFGQGTKLEIKGGGGSGGGGSGGGGSQVQLLESGGGVVQPGRSLRLSCAASGFTFSFYGMHWVRQAPGKGLEWVAAISYDGSNKYYADSVKGRFTISRDNSKNTLYLQMNSLRAEDTAVYYCAKRPNQFYCSDGRCYSIDYWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7680 - protein, 575 aa, Artificial Sequence
  Synthetic Polypeptide encoding a Bispecific T cell engager antibody
MALPVTALLLPLALLLHAARPQSVLTQPPSASAGGTPGQRVTISCSGSSSNIGSNFVYWYQQLPGTAPKLLIYRNNQRPSGVPDRFSGSRSGTSASLAGLRSEDEADYYCAADSLGGHYVFGTGTKVLGGGGSGGGGSGGGGSQVQLVESGGGSVQPGRSLRLSCEASGFTFEAYAMHWVRQPPGKGLEWVSSINWNSGRIAYADSVKGRFTISRDNARNSLYLQMNSLRLEDTAFYYCAKDIRRFSTGGAEFEYWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7681 - protein, 570 aa, Artificial Sequence
  Synthetic Polypeptide encoding a Bispecific T cell engager antibody
MALPVTALLLPLALLLHAARPENVLTQSPAIMSASPGEKVTMTCSASSSVSYMHWYQQKSSTSPKLWIYDTSKLASGVPGRFSGSGSGNSYSLTISSMEAEDVATYYCFQGSGYPLTFGAGTKLELKGGGGSGGGGSGGGGSQVQLKESGPGLVAPSQSLSITCTVSGFSLSSQGVYWVRQPPGKGLEWLGAIWAGGSTNYNSALMSRLSISKDNSKSQVFLKMNSLQTDDTAMYYCARVDGYRGYNMDYWGQGTSVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7682 - protein, 574 aa, Artificial Sequence
  Synthetic Polypeptide encoding a Bispecific T cell engager antibody
MALPVTALLLPLALLLHAARPDDIQMTQSPSSLSASVGDRVTITCRASQSISSYLNWYQQKPGKAPKLLIYDASNLETGVPSRFSGSGSGTDFTFTISSLQPEDIATYYCQQYDNLPLTFGGGTKVDIKRGGGGSGGGGSGGGGSQVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARAHNSSSWSFDYWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7683 - protein, 583 aa, Artificial Sequence
  Synthetic Polypeptide encoding a Bispecific T cell engager antibody
MALPVTALLLPLALLLHAARPDDVVMTQSPLSLPVSLGDQASISCRSSQRLVHSNGNTYLHWYLQKPGQSPKLLIYRVSNRFPGVPDRFSGSGSGTDFTLKISRVEAEDLGIYFCSQSTHVPYTFGGGTKLEIKRGGGGSGGGGSGGGGSEVRLQQSGPDLIKPGASVKMSCKASGYTFTGYVMHWVKQRPGQGLEWIGFINPYNDDIQSNERFRGKATLTSDKSSTTAYMELSSLTSEDSAVYYCARGAGYNFDGAYRFFDFWGQGTTLTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7684 - protein, 574 aa, Artificial Sequence
  Synthetic Polypeptide encoding a Bispecific T cell engager antibody
MALPVTALLLPLALLLHAARPDSYELTQPPSVSVSPGQTATISCSGDQLGGKYGHWYQKKPGQSPVLVLYQDRKRPAGIPERFSGSSSGNTITLTISGTQAVDEADYYCQAWDTNLGGVFGGGTKVTVLGQGGGGSGGGGSGGGGSQVQLVESGAEVKKPGASVKVSCKASGYTFTGYYMHWVRQAPGQGLEWMGRINPNSGGTNYAQKFQGRVTMTRDTSISTAYMELSRLRSDDTAVYYCASPRGRGSAFDIWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7685 - protein, 577 aa, Artificial Sequence
  Synthetic Polypeptide encoding a Bispecific T cell engager antibody
MALPVTALLLPLALLLHAARPDNFMLTQPHSVSESPGKTVTISCTRSSGSIASKYVQWYQQRPGSSPTTVIYEDNQRPSGVPDRFSGSIDTSSNSASLTISGLRTEDEADYYCHSYDSNNHSVFGGGTKVTVLGQGGGGSGGGGSGGGGSEVQLVESGGGVVQPGGSLRLSCAASGFTFSSYAMSWVRQAPGKGLEWVSAISGSGGSTYYADSVKGRFSISRDNSKNTLYLQMNSLRAEDTAVYYCARTRSSGAFDIWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7686 - protein, 572 aa, Artificial Sequence
  Synthetic Polypeptide encoding a Bispecific T cell engager antibody
MALPVTALLLPLALLLHAARPDIQMNQSPSSLSASLGDTITITCHASQNINVWLSWYQQKPGNIPKLLIYKASNLHTGVPSRFSGSGSGTGFTITISSLQPEDIATYYCQQGQSYPWTFGGGTKLEIKRGGGGSGGGGSGGGGSEVQLQQSGPELVKPGASVKISCKASGYSFTGYFMNWVKQSHGKSLEYIGRFNPYNGETLYNQKFKGKATLTVDKSSSTVHMELLSVTSEDSAVYYCGRSGNDDAMDYWGQGTSVTVSSATRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7687 - protein, 573 aa, Artificial Sequence
  Synthetic Polypeptide encoding a Bispecific T cell engager antibody
MALPVTALLLPLALLLHAARPDDIQMTQSPSILSASVGDRVTITCRASQRFGDYLAWYQQKPGQAPKLLIYGASTLQSGVPSRFSGSGSGTEFTLTISGLQPEDFATYYCQQANSFPITFGKGTRLDIRRGGGGSGGGGSGGGGSQVQLVQSGAEVKKPGSSVKVSCKASGGTFSSYAISWVRQAPGQGLEWMGWINVGNGNAIYSQKFQGRVTITRDTSATTAYMELSSLRSEDTAVYYCARDGERAWDLDYWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7688 - protein, 578 aa, Artificial Sequence
  Synthetic Polypeptide encoding a Bispecific T cell engager antibody
MALPVTALLLPLALLLHAARPDETTLTQSPGTLSLSPGERATLSCRASQSVSSSYLAWYQQKPGQAPRLLIYGASSRATGIPDRFSGSGSGTDFTLTISRLEPEDFAVYYCQQYGSSPYTFGQGTKLEIKRGGGGSGGGGSGGGGSQVQLVQSGGGVVQPGRSLRLSCAASGFTFSSYAMHWVRQAPGKGLEWVAVISYDGSNKYYADSVKGRFTISRDNSKNTLYLQMNSLRAEDTAVYYCARELRFLEWSSDAFDIWGQGTMVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7689 - protein, 573 aa, Artificial Sequence
  Synthetic Polypeptide encoding a Bispecific T cell engager antibody
MALPVTALLLPLALLLHAARPEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKGGGGSGGGGSGGGGSQLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTMIRGVIDSWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7690 - protein, 570 aa, Artificial Sequence
  Synthetic Polypeptide encoding a Bispecific T cell engager antibody
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSGGGGSGGGGSQVQLVQSGAEVRKPGSSVKVSCKASGGSFNNYPIFWVRQAPGQGFEWMGRIIPILGITAYAQKFQGRVTITADKSTSTAYMELNSLRSEDTAVYYCAGGDDLDAFDIWGQGTMVSVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7691 - protein, 582 aa, Artificial Sequence
  Synthetic Polypeptide encoding a Bispecific T cell engager antibody
MALPVTALLLPLALLLHAARPDIVMTQTPLSLPVTPGEPASISCRSSRSLLDSDDGNTYLDWYLQKPGQSPQLLIYTLSYRASGVPDRFSGSGSGTDFTLKISRVEAEDVGVYYCMQRVEFPITFGQGTRLEIKRGGGGSGGGGSGGGGSQVQLVESGGGVVQPGRSLRLSCAASGFIFSRYGMHWVRQAPGKGLKWVAVIWYDGSNKLYADSVKGRFTISRDNSKNTLYLQMNSLRAEDTAVYYCARDYYDNSRHHWGFDYWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7692 - protein, 572 aa, Artificial Sequence
  Synthetic Polypeptide encoding a Bispecific T cell engager antibody
MALPVTALLLPLALLLHAARPEIQMTQSPSSMSASLGDTITITCQATQDIFKNLNWYQQKPGKPPSLLIYYATELAEGVPSRFSGSGSGSDYSLTISNLESEDFAAYYCLQFFEFPFTFGSGTKLEMKGGGGSGGGGSGGGGSQVQLQQSGAELVRPGTSVKVSCKASGYVFTNYWIEWIKQRPGQGLEWIGVMNPGSGETTYNEKFKGKATLTADKSSSTAYMQLSSLTSVDSAVYFCARDHDRDYYAMDYWGQGTSVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7693 - protein, 569 aa, Artificial Sequence
  Synthetic Polypeptide encoding a Bispecific T cell engager antibody
MALPVTALLLPLALLLHAARPDILLTQSPAILSVSPGERVSFSCRASQNIGTSIHWYQQRTNGSPRLLIKYASESVSGIPSRFSGSGSGTDFTLSINSVESEDIADYYCQHTNSWPTTFGGGTKLEIKRGGGGSGGGGSGGGGSQVQLQQSDAELVKPGASVKISCKASGYTFTDHAIHWVKQKPEQGLEWIGYFSPGNGDIKYNEKFKGKATLTADKSSSTAYMQLNSLTSEDSAVYFCKRSYGNYDYWGQGTTLTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7694 - protein, 574 aa, Artificial Sequence
  Synthetic Polypeptide encoding a Bispecific T cell engager antibody
MALPVTALLLPLALLLHAARPDIVMTQSPDSLAVSLGERATINCKSSQSLLNSGDQKNYLTWYQQKPGQPPKLLIYWASTRESGVPDRFSGSGSGTDFTLTISSLQAEDVAVYYCQNDYSYPLTFGQGTKVEIKGGGGSGGGGSGGGGSQVQLVQSGAEVKKTGSSVKVSCKASGYTFTDHAIHVWRQAPGQALEWMGHFSPGNTDIKYNDKFKGRVTLTVDRSMSTAYMELSSLRSEDTAMYYCKTSTFFFDYWGQGTMVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7695 - protein, 496 aa, Artificial Sequence
  Synthetic Polypeptide encoding a Bispecific T cell engager antibody
MELTELLLVVMLLLTARLTLSSPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQLPPQGRTTAHKDPNAIFLSFQHLLRGKVRFLMLVGGSTLCVRRAPPTTAVPSRTSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7696 - protein, 573 aa, Artificial Sequence
  Synthetic Polypeptide encoding a Bispecific T cell engager antibody
MALPVTALLLPLALLLHAARPDIQMTQSPSSLSASVGDRVTITCKASQDVSIAVAWYQQKPGKAPKVLIYSASYRYTGVPDRFSGSGSGTDFTFTISSLQPEDIAVYYCQQHYITPLTFGGGTKVEIKGGGGSGGGGSGGGGSQIQLVQSGHEVKKPGASVKVSCKASGYTFTNYGMNWVRQAPGQGLEWMGWINTKTGEPTYAEEFKGRFVFSLETSASTAYLQISSLKAEDTAMYFCGRGGYGSSYWYFDVWGQGTTVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7697 - protein, 575 aa, Artificial Sequence
  Synthetic Polypeptide encoding a Bispecific T cell engager antibody
MALPVTALLLPLALLLHAARPDIVMTQSPDSLAVSLGERATINCRASKSVSTSGYSYMHWYQQKPGQPPKLLIYLASNLESGVPDRFSGSGSGTDFTLTISSLQAEDVAVYYCQHSRELPYTFGQGTKLEIKGGGGSGGGGSGGGGSQVQLQESGPGLVKPSETLSLTCTVSGGSISSYGVHWIRQPPGKGLEWIGVIWTSGVTDYNSALMGRVTISVDTSKNQFSLKLSSVTAADTAVYYCARDGDYDRYTMDYWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7698 - protein, 554 aa, Artificial Sequence
  Synthetic Polypeptide encoding a Bispecific T cell engager antibody
MTALFLMSMLFGLACGQAMSFCIPTEYTMHIERRECAYCLTINTTICAGYCMTRDINGKLFLPKYALSQDVCTYRDFIYRTVEIPGCPLHVAPYFSYPVALSCKCGKCNTDYSDCIHEAIKTNYCTKPQKSYLVGFSVGGGGSGGGGSGGGGSAPDVQDCPECTLQENPFFSQPGAPILQCMGCCFSRAYPTPLRSKKTMLVQKNVTSESTCCVAKSYNRVTVMGGFKVENHTACHCSTCYYHKSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7699 - protein, 571 aa, Artificial Sequence
  Synthetic Polypeptide encoding a Bispecific T cell engager antibody
MALPVTALLLPLALLLHAARPQSVLTQPPSVSVSPGQTASITCSGDKLGDKYACWYQQKPGQSPVLVIYQDSKRPSGIPERFSGSNSGNTATLTISGTQAMDEADYYCQAWDSSTAVVFGGGTKLTVLGGGGSGGGGSGGGGSQVQLVQSGAEVKKPGQSLKISCKASGYSLTDNWIGWVRQKPGKGLEWMGIIYPGDSDTRYSPSFQGQVTISADKSINTAYLQWSSLKASDTAIYYCVGLDWNYNPLRYWGPGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7700 - protein, 569 aa, Artificial Sequence
  Synthetic Polypeptide encoding a Bispecific T cell engager antibody
MALPVTALLLPLALLLHAARPDIVMTQSQKFMSTSVGDRVSIICKASQNVGTFVAWYQQKPGQSPKLLVYSASNRYTGVPDRFTGSGSGTDFTLTINNMQSEDLADYFCRQYSSYPYTFGGGTKLEIKGGGGSGGGGSGGGGSEVQLQQSGPELVKPGASMKISCKASGYSFSAYTMNWVKQSHGKNLEWIGLINPYNGGTNYNQEFEGKATLTVNKSSNTAFMELLSLTSDDSAVYYCARRDWDYFDYWGQGTTLTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7701 - protein, 580 aa, Artificial Sequence
  Synthetic Polypeptide encoding a Bispecific T cell engager antibody
MALPVTALLLPLALLLHAARPAIQMTQSPSSLSASVGDRVTITCRASQSISNYLNWYQQKPGKAPKLLIYAASSLQSGVPSRFSGSGSGTDFTLTISSLQPEDFATYYCQQSYSSPSTTFGQGTKLEIKRGGGGSGGGGSGGGGSEVQLVESGGGLIQPGGSLRLSCAASGFTVSSNYMSWVRQAPGKGLEWVSVTYSGGSTSYADSVKGRFTISRDNSKNTLYLQMNSLRAEDTAVYYCARGGRYCSSISCYARSGCDYWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7702 - protein, 575 aa, Artificial Sequence
  Synthetic Polypeptide encoding a Bispecific T cell engager antibody
MALPVTALLLPLALLLHAARPDIQMTQSPSSLSASVGDRVTITCRASQSIGTSLHWYQQKPGKAPKLLIKFASRLQSGVPSRFSGSGSGTDFTLTISSLQPEDFATYYCQQSPGFPPTFGQGTKLEIKRGGGGSGGGGSGGGGSQVQLVESGGGLVKPGGSLRLSCAASGFSITTSGYYWTWIRQFPGKGLEWMGYIGYNSKTYYNPALKSRITISRDNAKNSLYLQMNSLRAEDTAVYYCARSLYGGYKDAFDSWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7703 - protein, 580 aa, Artificial Sequence
  Synthetic Polypeptide encoding a Bispecific T cell engager antibody
MALPVTALLLPLALLLHAARPDEIVLTQSPLSLPVTPGEPASISCRSSQSLLHSIGYNYLDWYLQKPGQSPQLLIYLGSNRASGVPDRFSGSGSGTDFTLKISRVEAEDVGVYYCMQALQTPLTFGGGTKVEIKRGGGGSGGGGSGGGGSEVQLVESGGGVVQPGRSLRLSCAASGFTFRSYGMHWVRQAPGKGLEWVAVISYDGSNKYYTDSVNGRFTISRDNSKNTLYLQMNSLRAEDTAVYYCARGGGYYETSGPDYWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7704 - protein, 578 aa, Artificial Sequence
  Synthetic Polypeptide encoding a Bispecific T cell engager antibody
MALPVTALLLPLALLLHAARPDDVVMTQSPLSLPVTPGEPASISCRSSQSLLHSIGYNYLHWFLQKPGQSPQLLIYLGSNRASGVPDRFSGSGSGTDFTLKISRVEAEDVGVYYCMQALQTPPTFGQGTRLEIKRGGGGSGGGGSGGGGSQLQLQESGPGLVKPSGTLSLTCAVSGGSISSSNWWSWVRQPPGKGLEWIGEIYHSGSTNYNPSLKSRVTISVDKSKNQFSLKLSSVTAADTAVYYCVGSPYGDYVLDYWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7705 - protein, 581 aa, Artificial Sequence
  Synthetic Polypeptide encoding a Bispecific T cell engager antibody
MALPVTALLLPLALLLHAARPDVVMTQSPLSLPVTPGEPASISCRSSQSLLHSNGHNYLDWYLQKPGQSPQLLIYLGSNRASGVPDRFSGSGSGTDFTLKISRVEAEDVGVYYCMQTLQTPLTFGPGTKVDIKRGGGGSGGGGSGGGGSEVQLVETGGGVVQPGRSLRLSCAASGFTFSSYGMHWVRQAPGKGLEWVAVISYDGSNKYYADSVKGRFTISRDNSKNTLYLQMNSLRAEDTAVYYCAKDRYGWGSSFGHFDYWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7706 - protein, 576 aa, Artificial Sequence
  Synthetic Polypeptide encoding a Bispecific T cell engager antibody
MALPVTALLLPLALLLHAARPDEIVLTQSPGTLSLSLGERATLSCRASQSISSSFLAWYQQKPGQAPKLLIYAASTRATGIPDRFSGSGSGTDFTLTISRLEPEDFAVYYCQQYGRSLSFGGGTKVEVKGGGGSGGGGSGGGGSQVQLQQSGPGLVKPSQTLSLTCAISGDSVSGNSATWNWIRQSPSRGLEWLGRTYYRSKWNHDYAESVKSRITINPDTSKNQFSLQLNSVTPEDTAVYYCARGDSSSWYAFDYWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7707 - protein, 576 aa, Artificial Sequence
  Synthetic Polypeptide encoding a Bispecific T cell engager antibody
MALPVTALLLPLALLLHAARPDQTVVTQPPSASGTPGQRVTISCSGSSSNIGSNYVYWYQQLPGTAPKLLIYRSNQRPSGVPDRFSGSKSGTSASLAISGPRSVDEADYYCAAWDDSLNGVVFGGGTKLTVLGGGGGSGGGGSGGGGSQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARRIPPYYGMDVWGQGTTVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7708 - protein, 576 aa, Artificial Sequence
  Synthetic Polypeptide encoding a Bispecific T cell engager antibody
MALPVTALLLPLALLLHAARPDQSVVTQPPSVSVAPGKTARITCGRNNIGSKSVHWYQQKPGQAPVLVVYDDSDRPSGIPERFSGSNSGNTATLTISRVEAGDEADYYCQVWDSSSDHVVFGGGTKLTVLGGGGGSGGGGSGGGGSEVQLVQSGGGVVRPGGSLRLSCAASGFTFDDYGMSWVRQAPGKGLEWVSGINWNGGSTGYADSVRGRFTISRDNAKNSLYLQMNSLRAEDTALYYCARERGYGYHDPHDYWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7709 - protein, 588 aa, Artificial Sequence
  Synthetic Polypeptide encoding a Bispecific T cell engager antibody
MALPVTALLLPLALLLHAARPEQKLISEEDLEFQAVVTQPPSASGTPGQRVTISCSGSSSNIGSNTVNWYQQVPGTAPKLLIYSNNQRPSGVPDRFSGSKSGTSASLAISGLQSEDEADYYCAAWDDSLNGWVFGGGTKLTVLGGGGSGGGGSGGGGSQMQLVQSGAEVKEPGESLRISCKGSGYSFTNFWISWVRQMPGKGLEWMGRVDPGYSYSTYSPSFQGHVTISADKSTSTAYLQWNSLKASDTAMYYCARVQYSGYYDWFDPWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7710 - protein, 582 aa, Artificial Sequence
  Synthetic Polypeptide encoding a Bispecific T cell engager antibody
MALPVTALLLPLALLLHAARPEQKLISEEDLEFDIQMTQSPSTLSASVGDRVTITCRASQNINKWLAWYQQRPGKAPQLLIYKASSLESGVPSRFSGSGSGTEYTLTISSLQPDDFATYYCQQYNSYATFGQGTKVEIKRGGGGSGGGGSGGGGSQVQLVQSGAEVKKPGESLKISCKGSGYNFSNKWIGWVRQLPGRGLEWIAIIYPGYSDITYSPSFQGRVTISADTSINTAYLHWHSLKASDTAMYYCVRHTALAGFDYWGLGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7711 - protein, 572 aa, Artificial Sequence
  Synthetic Polypeptide encoding a Bispecific T cell engager antibody
MALPVTALLLPLALLLHAARPEIVLTQSPGTLSLSPGERATLSCRASQSVSNTYLAWYHQRPGQAPRLLIYGASSRATGIPDRFSGSGSGTDFALTISSLEPEDFAVYYCQQYSNSWTFGQGTKVEIKRGGGGSGGGGSGGGGSQVQLVESGGGVVQPGRSLRLSCAASGFTFSSYDMHWVRQAPGKGLEWVAVISYDGTNEYYADSVKGRFTISRDTSKNTLYLQMNSLRAEDTAVYYCARERYFDWSFDYWGQGTLVSVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7712 - protein, 571 aa, Artificial Sequence
  Synthetic Polypeptide encoding a Bispecific T cell engager antibody
MALPVTALLLPLALLLHAARPELTQDPAVSVALGQTVRITCQGDSLRSNYANWYQQKPGQAPVLVIYGQNNRPSGIPDRFSGSSSGNTASLTITGAQAADEADYYCDSRVSTGNHVVFGGGTKLTVLGQGGGGSGGGGSGGGGSEVQLVQSGAEVKKPGASVKVSCKASGYTFTSYAMHWVRQAPGQRLEWMGWINAGNGNTKYSQKFQGRVTITRDTSASTAYMELSSLRSEDTAVYYCARDISYGSFDYWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7713 - protein, 573 aa, Artificial Sequence
  Synthetic Polypeptide encoding a Bispecific T cell engager antibody
MALPVTALLLPLALLLHAARPDIVLTQTPATLSVTPGDSVSLSCRASQSISNNLHWYQQKSHESPRLLIKNASQSISGIPSKFSGSGSGTDFTLRINSVETEDFGMYFCQQSNSWPYTFGSGTKLEIKGGGGSGGGGSGGGGSQVKLQQSGPELVKPGASVKISCKASGYSFTGYYMHWVKQSHGNILDWIGYIYPYNGVSSYNQKFKGKATLTVDKSSSTAYMELRSLTSEDSAVYYCARERGLYQLRAMDYWGQGTSVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7714 - protein, 564 aa, Artificial Sequence
  Synthetic Polypeptide encoding a Bispecific T cell engager antibody
MALPVTALLLPLALLLHAARPDIVMTQTPAIMSASPGQKVTITCSASSSVNYMHWYQQKLGSSPKLWIYDTSKLAPGVPARFSGSGSGTSYSLTISSMEAEDAASYFCHQWSSYPYTFGSGTKLEIKGGGGSGGGGSGGGGSEVQLQESGPDLVKPSQSLSLTCTVTGYSITSGYGWHWIRQFPGNKLEWMGYIHYSGSTTYNPSLKSRISISRDTSKNQFFLQLNSVTTEDTATYYCARSLRYWGQGTTLTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7715 - protein, 567 aa, Artificial Sequence
  Synthetic Polypeptide encoding a Bispecific T cell engager antibody
MALPVTALLLPLALLLHAARPDIQMTQSPSSLSASVGDRVTITCSATSSISYMHWYQQKPGKAPKGWIYDTSKLAHGVPSRFSGSGSGTDFTLTISSLQPEDFATYYCHQRRSYPFTFGQGTKVEIKGGGGSGGGGSGGGGSEVQLVQSGAEVKKPGASVKVSCKASGYTFTNFWIHWVRQAPGQGLEWIGEIDPSDSYTNYNQKFKGRVTITRDTSTSTAYLELSSLRSEDTAVYYCAREITTVDYWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7716 - protein, 574 aa, Artificial Sequence
  Synthetic Polypeptide encoding a Bispecific T cell engager antibody
MALPVTALLLPLALLLHAARPDIQMTQSPSSLSASVGDRVTITCKASQGFNKYVAWYQQKPGKAPKLLIYYTSTLQPGVPSRFSGSGSGRDYTLTISSLQPEDFATYYCLQYGNLLYAFGQGTKVEIKRGGGGSGGGGSGGGGSEVQLVQSGAEVKKPGASVKVSCKASGYTFTSYWIGWVRQAPGQGLEWIGDIYPGGGYTNYNEKFKGRVTITRDTSTSTAYLELSSLRSEDTAVYYCARLDGSSYRGAMDSWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7717 - protein, 578 aa, Artificial Sequence
  Synthetic Polypeptide encoding a Bispecific T cell engager antibody
MALPVTALLLPLALLLHAARPDIQLTQSPSSLSASVGDRVTITCRASQSVDYDGDSYMNWYQQKPGKAPKLLIYAASYLESGVPSRFSGSGSGTDFTLTISSLQPEDFATYYCQQSHEDPYTFGQGTKVEIKRGGGGSGGGGSGGGGSEVQLVESGGGLVQPGGSLRLSCAVSGYSITSGYSWNWIRQAPGKGLEWVASITYDGSTNYNPSVKGRITISRDDSKNTFYLQMNSLRAEDTAVYYCARGSHYFGHWHFAVWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7718 - protein, 570 aa, Artificial Sequence
  Synthetic Polypeptide encoding a Bispecific T cell engager antibody
MALPVTALLLPLALLLHAARPDIQMTQSPSSLSASVGDRVTITCRASQDIRYYLNWYQQKPGKAPKLLIYVASSLQSGVPSRFSGSGSGTEFTLTVSSLQPEDFATYYCLQVYSTPRTFGQGTKVEIKGGGGSGGGGSGGGGSEVQLVESGGGLAKPGGSLRLSCAASGFRFTFNNYYMDWVRQAPGQGLEWVSRISSSGDPTWYADSVKGRFTISRENAKNTLFLQMNSLRAEDTAVYYCASLTTGSDSWGQGVLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7719 - protein, 571 aa, Artificial Sequence
  Synthetic Polypeptide encoding a Bispecific T cell engager antibody
MALPVTALLLPLALLLHAARPEIVMTQSPATLSVSPGERATLSCRASQSVSRNLAWYQQKPGQAPRLLIYGASTRATGIPARFSGSGSGTEFTLTIGSLQSEDFAVYYCQQYKTWPRTFGQGTNVEIKGGGGSGGGGSGGGGSQVQLQQWGAGLLKPSETLSLTCAVFGGSFSGYYWSWIRQPPGKGLEWIGEINHRGNTNDNPSLKSRVTISVDTSKNQFALKLSSVTAADTAVYYCARERGYTYGNFDHWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7720 - protein, 572 aa, Artificial Sequence
  Synthetic Polypeptide encoding a Bispecific T cell engager antibody
MALPVTALLLPLALLLHAARPEIVMTPSSATLSVSPGERATLSCRASQSVSRNLAWYQQKPGQAPRLLIYGASTRATGIPARFSGSGSGTEFTLTISSLQSEDFAVYYCHQYSNWMCSFGQGTKLEIKGGGGSGGGGSGGGGSEVQLLESGGGLVQPGGSLRLSCAASGFTFSRYAMNWVRQAPGKGLEWVSGISGSGGRTYYADSVKGRFTISRDNSKNTLYLQMNSLRAEDTAVYYCAKDRDFWSGPFDYWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7721 - protein, 572 aa, Artificial Sequence; identical to SEQ ID NO: 7720
  Synthetic Polypeptide encoding a Bispecific T cell engager antibody

SEQ ID NO: 7722 - protein, 574 aa, Artificial Sequence
  Synthetic Polypeptide encoding a Bispecific T cell engager antibody
MALPVTALLLPLALLLHAARPQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSELVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7723 - protein, 575 aa, Artificial Sequence
  Synthetic Polypeptide encoding a Bispecific T cell engager antibody
MALPVTALLLPLALLLHAARPEVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDKGGGYYDFWSGSDYWGQGTLVTVSSGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCNSRDSSGWVFGGGTKLTVLTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7724 - protein, 584 aa, Artificial Sequence
  Synthetic Polypeptide encoding a Bispecific T cell engager antibody
MALPVTALLLPLALLLHAARPEVQLQQSGPGLVKPSQTLSLTCAISGDSVLSNSDTWNWIRQSPSRGLEWLGRTYHRSTWYDDYASSVRGRVSINVDTSKNQYSLQLNAVTPEDTGVYYCARDRLQDGNSWSDAFDVWGQGTMVTVSSGGGGSGGGGSGGGGSQSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLVYVFGTGTKVTVLTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7725 - protein, 582 aa, Artificial Sequence
  Synthetic Polypeptide encoding a Bispecific T cell engager antibody
MALPVTALLLPLALLLHAARPQVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARGDSNYWSYYGMDVWGQGTLVTVSSGGGGSGGGGSGGGGSGGGGSQSVLTQPRSVSGSPGQSVTISCTGTSSDVGGYNYVSWYQQHPGEAPKLIIYDADKRPSGISNRFSSGKSGNTASLTISGLQVEDEADYYCCSYAGGSTWVFGGGTKVTVLTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7726 - protein, 584 aa, Artificial Sequence
  Synthetic Polypeptide encoding a Bispecific T cell engager antibody
MALPVTALLLPLALLLHAARPEVQLQQSGPGLVKPSQTLSLTCAISGDSVSSNSAAWNWIRQSPSRGLEWLGRTYYRSKWYSDYAVSVKSRITINPDTSKNQFSLQLNSVTPEDTAVYYCARDPYDFWSGYPDAFDIWGQGTMVTVSSGGGGSGGGGSGGGGSQSALTQPASVSGSPGQSITISCTGTSSDVGGYNYVSWYQQHPGKAPKVIISEVNNRPSGVSHRFSGSKSGNTASLTISGLQAEDEADYFCSSYTSGRTLYVFGTGSKVTVLGTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7727 - protein, 583 aa, Artificial Sequence
  Synthetic Polypeptide encoding a Bispecific T cell engager antibody
MALPVTALLLPLALLLHAARPEVQLQQSGPGLVKPSQTLSLTCAISGDSMLSNSDTWNWIRQSPSRGLEWLGRTYHRSTWYDDYASSVRGRVSINVDTSKNQYSLQLNAVTPEDTGVYYCARVRLQDGNSWSDAFDVWGQGTMVTVSSGGGGSGGGGSGGGGSQSALTQPASASGSPGQSVTISCTGTSSDVGGYNYVSWYQQHPGKAPKLMIYDVSNRPSGVSNRFSGSKSGNTASLTISGLQAEDEADYYCSSYTSSSTLYVFGTGTQLTVLTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7728 - protein, 570 aa, Artificial Sequence
  Synthetic Polypeptide encoding a Bispecific T cell engager antibody
MALPVTALLLPLALLLHAARPDVVMTQSPSSLSASVGDRVTITCMASEDIYIRLAWYQQKPGNAPKLLIYAATSLETGVPSRFSGSGSGTDFTLTISSLQPEDFATYYCQQYWSSPWTFGGGTKVEIKGGGGSGGGGSGGGGSQVQLQESGPGLVKPSQTLSLTCTVSGYSITSDYTWNWIRQPPGNGLEWIGYITYSGSTSYNPSLKSRVLISVDTSKNQVSLKLSSVTAADTAVYYCARLGRRYTMDYWGQGTTVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7729 - protein, 574 aa, Artificial Sequence
  Synthetic Polypeptide encoding a Bispecific T cell engager antibody
MALPVTALLLPLALLLHAARPEIVLTQSPATLSLSPGERATLSCSASSSVSYMYWYQQKPGQAPRLLIYRTSNLASGIPARFSGSGSGTDFTLTISSLEPEDFAVYYCQQYHSYPTTFGQGTKVEIKRTVGGGGSGGGGSGGGGSEVQLVESGGGLVQPGGSLRLSCAASGFSFNTYAMNWVRQAPGKGLEWVSHIRSKSNNFATYYADSVKDRFTISRDNAKNSLYLQMNSLRAEDTAVYYCARQGGDFPMDYWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7730 - protein, 570 aa, Artificial Sequence
  Synthetic Polypeptide encoding a Bispecific T cell engager antibody
MALPVTALLLPLALLLHAARPDVVMTQSPSSLSASVGDRVTITCKASEDIYIRLAWYQQKPGKAPKLLIYAATSLETGVPSRFSGSGSGTDFTLTISSLQPEDFATYYCQQYWTTPWTFGGGTKVEIKGGGGSGGGGSGGGGSQVQLQESGPGLVKPSQTLSLTCTVSGYSITIDYTWNWIRQPPGKGLEWIGYITYSGSTDYNPSLKSRVLISVDTSKNQVSLKLSSVTAADTAVYYCARLGRRYALDYWGQGTTVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7731 - protein, 572 aa, Artificial Sequence
  Synthetic Polypeptide encoding a Bispecific T cell engager antibody
MALPVTALLLPLALLLHAARPDVVMTQSPSSLSASVGDRVTITCRASQDISKYLNWYQQKPGKAPKLLIYHTSRLHSGVPSRFSGSGSGTDFTLTISSLQPEDFATYYCQQGNTLPYTFGGGTKVEIKGGGGSGGGGSGGGGSQVQLQESGPGLVKPSQTLSLTCTVSGVSLPDYGVSWIRQPPGKGLEWIGVIWGSETTYYNSALKSRVLISVDTSKNQVSLKLSSVTAADTAVYYCARHYYYGGSYAMDYWGQGTTVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7732 - protein, 579 aa, Artificial Sequence
  Synthetic Polypeptide encoding a Bispecific T cell engager antibody
MALPVTALLLPLALLLHAARPEIVLTQSPATLSLSPGERATLSCRASQSVSIYLAWYQQKPGQAPRLLIYDASNRATGIPARFSGSGSGTDFTLTISSLEPEDFAVYYCQQRSNWPPFTFGPGTKVDIKGGGGSGGGGSGGGGSQVQLVESGGGVVQPGRSLRLSCAASGFTFSSYGMHWVRQAPGKGLEWVAVIWDDGSNKYYVDSVKGRFTISRDNSKNTLYLQMNSLRAEDTAVYYCARDDYYGSGSFNSYYGTDVWGQGTTVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7733 - protein, 564 aa, Artificial Sequence
  Synthetic Polypeptide encoding a Bispecific T cell engager antibody
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSGGGGSGGGGSEVQLVQSGGGLVHPGGSLRLSCAGSGFTFSTYLMYWVRQAPGKTLEWVSAIGSGGDTYYADSVKGRFTISRDNAKNSLYLQMNSLRAEDMAVYYCARGLGYWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7734 - protein, 568 aa, Artificial Sequence
  Synthetic Polypeptide encoding a Bispecific T cell engager antibody
MALPVTALLLPLALLLHAARPQIVLTQSPAIMSASPGEKVTITCSASSSVSYMHWFQQKPGTSPKLWIYSTSNLASGVPARFSGSGSGTSYSLTISRMEAEDAATYYCQQRSSYPPTFGGGTKLEIKGGGGSGGGGSGGGGSQVQLQQSGAELMKPGASVKISCKATGYTFSSYWIEWVKQRPGHGLEWIGEILPGSGSTNYNEKFKGKATFTADTSSNTAYMQLSSLTSEDSAVYYCARYDYPWFAYWGQGTLVTVSATRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7735 - protein, 576 aa, Artificial Sequence
  Synthetic Polypeptide encoding a Bispecific T cell engager antibody
MALPVTALLLPLALLLHAARPDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPFTFGSGTKLEIKGGGGSGGGGSGGGGSQVQLQQPGAELVRPGASVKLSCKASGYTFTSYWINWVKQRPGQGLEWIGNIYPSDSYTNYNQKFKDKATLTVDKSSSTAYMQLSSPTSEDSAVYYCTRSWRGNSFDYWGQGTTLTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7736 - protein, 574 aa, Artificial Sequence
  Synthetic Polypeptide encoding a Bispecific T cell engager antibody
MALPVTALLLPLALLLHAARPDTQMTQSPSSVSASVGDRVTITCRTSQDISNYLNWYQQKPGKAPKLLIYNTSRLHSGVPSRFSGSGSGTDFTLTISSLQPEDFATYYCQQSNMFPYTFGQGTKLEIKGGGGSGGGGSGGGGSQVQLVQSGAEVKKPGASVKVSCKASGYTFNGYFMNWVRQAPGQGLERMGRINPNNGDSFYNQKFQGRVTMTRDTSTSTVYMELPSLRSEDTAVYYCAREGYYGGRGYALDYWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7737 - protein, 575 aa, Artificial Sequence
  Synthetic Polypeptide encoding a Bispecific T cell engager antibody
MALPVTALLLPLALLLHAARPDIQLTQSPSFLSASVGDRVTITCRASQGISTDLNWYQQKPGKAPKLLIYAASNLESGVPSRFSGSGSGTEFTLTISSLQPEDFATYYCQQSYNWPYTFGGGTKVEIKRGGGGSGGGGSGGGGSEVQLVESGGGLVKPGGSLRLSCAASGFTFSNFEMNWVRQAPGKGLEWVSGISSNGRYINYADSVKGRFTISRDNAKNSLYLQMNSLRAEDTAVYYCARVVDFDQDYNGFDYWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7738 - protein, 573 aa, Artificial Sequence
  Synthetic Polypeptide encoding a Bispecific T cell engager antibody
MALPVTALLLPLALLLHAARPDIQLTQSPSFLSASVGDRVTITCSLSLGISTWRDWFPPRLGRGLEPLTYAASTLQSGVPSRFSGSGSGTEFTLTISSLQPEDFATYYCQQLNSYPLTFGGGTKVEIKRGGGGSGGGGSGGGGSEVQLVESGGGLVKPGGSLRLSCAASGFTFSTYGMSWVRQAPGKGLEWVAYINNGSGYIYYADSVKGRFTISRDNAKNSLYLQMNSLRAEDTAVYYCARGQWWSGGDFDYWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7739 - protein, 576 aa, Artificial Sequence
  Synthetic Polypeptide encoding a Bispecific T cell engager antibody
MALPVTALLLPLALLLHAARPELVMTQSPASLAVSLGQRATISCRASESVDSYGKSFMHWYQLKPGQPPKLLIYRASNLESGVPARFSGSGSRTDFTLTIDPVEADDAATYYCQQNNEDPWTFGGGTKLEIKGGGGSGGGGSGGGGSEVQLEQSGPELVKPGASVKMSCKASGYTFTNYYMKWVKQSHGKSLEWIGDLNPNNGDTFYNQKFKGKATLTVDKSSNTAYMQLNSLTSEDSAVYYCARTGRYEENAMDYWGQGTSVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7740 - protein, 573 aa, Artificial Sequence
  Synthetic Polypeptide encoding a Bispecific T cell engager antibody
MALPVTALLLPLALLLHAARPQSVVTQPPSVSAAPGQKVTISCSGSSSNIGNNYVSWYQQLPGTAPKLLIYDNNKRPSGIPDRFSASKSGTSATLGITGLQTRDEADYYCGTWDSSLSAWVFGGGTKLTVLGGGGGSGGGGSGGGGSQVQLVQSGAEVKKPGSSVKVSCKASGDTFSSYYISWVRQAPGQGLEWMGRIIPILGIANYAQKYQGRVTLSADKSTSTSYMELNSLSSEDTAVYYCALDWSYSIDYWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7741 - protein, 573 aa, Artificial Sequence
  Synthetic Polypeptide encoding a Bispecific T cell engager antibody
MALPVTALLLPLALLLHAARPQSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSVFGTGTKVLVLGGGGSGGGGSGGGGSQVQLVQSGAEVKKPGSSVKVSCKASGGTFSSYTINVWRQAPGQGLEWMGGFIPISGTVNYAQKFQGRVTITADESTSTAYMELSSLRSEDTAVYYCARPLDWTEDIWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7742 - protein, 576 aa, Artificial Sequence
  Synthetic Polypeptide encoding a Bispecific T cell engager antibody
MALPVTALLLPLALLLHAARPNFMLTQPHSVSESPGKTVTISCTGSSGSIASNYVQWYQQRPGSAPTILIYEDNKRPSGVPDRFSGSIDSSSNSASLTISGLKTGDEADYYCQSYDDINHWVFGGGTKLTVLGGGGGSGGGGSGGGGSEVQLVQSGAEVKKPGASVKVSCKASGYTFTAYYLHWLRQAPGQGLEWMGWMNTNNGATRYAQKFQDRVTMTRDTSINTAYMEMSGLSSDDTAMYYCARGDISQDFADVWGQGTLVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7743 - protein, 583 aa, Artificial Sequence
  Synthetic Polypeptide encoding a Bispecific T cell engager antibody
MALPVTALLLPLALLLHAARPDVMLTQTPLSLPVSLGDQASISCRSSQSILHSTGDTYLEWYLQKPGQSPKLLINKVSNRLSGVPDRFSGSGSGTDFTLKISRVEAEDLGVYYCFQGSHVPWTFGGGTKLEIKRADAAPTVSIFPGGGGSGGGGSGGGGSQVKLQQSGPSLVKPGASVKMSCKASGYTFTDFYMKWVKQSHGKSLEWIGDINPNIGDTFYNQKFKGKATLTVDKSSSTAYMQLNSLTSEDSAVYFCSVGYFDVWGAGTTVTVSSTRTRGSAWSHPQFEKGGGSGGGSGGSAWSHPQFEKSRSSGGGGSQVQLVQSGGGVVQPGRSLRLSCKSSGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSVEGGSGGSGGSGGSGGVDDIQMTQSPSSLSASVGDRVTITCRASSSVSYMNWYQQTPGKAPKRWIYDTSKVASGVPSRFSGSGSGTDYTFTISSLQPEDIATYYCQQWSSNPLTFGQGTKLQITEQKLISEEDLSGGSHHHHHHLE

SEQ ID NO: 7744 - protein, 1364 aa, Artificial Sequence
  Synthetic Polypeptide encoding a CAR with  optional accessory module(s)
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSRVEQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGITMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLGTRGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 7745 - protein, 1364 aa, Artificial Sequence
  Synthetic Polypeptide encoding a CAR with  optional accessory module(s)
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSRVEQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGITMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLGTRGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAKQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 7746 - protein, 1196 aa, Artificial Sequence
  Synthetic Polypeptide encoding a CAR with  optional accessory module(s)
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSRVEQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGITMGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLGTRGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGLETDFYDYKDDDDKTSGSGEGRGSLLTCGDVEENPGPMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 7747 - protein, 623 aa, Artificial Sequence
  Synthetic Polypeptide encoding a CAR with  optional accessory module(s)
MALPVTALLLPLALLLHAARPDDIQMTQSSSSFSVSLGDRVTITCMASEDIYIRLAWYQQKPGNAPRLLISAATSLETGVPSRFSGSGSGKDYTLSITSLQTEDVGTYYCQQYWSSPWTFGGGTKLEINLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEDVQLQESGPGLVKPSQSLSLTCTVTGYSITSDYTWNWIRQFPGNKLEWMGYITYSGSTSYNPSLKSRNSITRDTSKNQFFLQLNSVTTEDTATYYCARLGRRYTMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSS

SEQ ID NO: 7748 - protein, 624 aa, Artificial Sequence
  Synthetic Polypeptide encoding a CAR with  optional accessory module(s)
MALPVTALLLPLALLLHAARPDQIVLTQSPAIMSASPGEKVTISCSASSSVSYMYWYQQKPGSSPKPWIYRTSNLASGVPARFSGSGSGTSYSLTISNMEAEDAAAYYCQQYHSYPTTFGGGTKLEVKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPKGSLKLSCAASGFSFNTYAMNWVRQAPGKGLEWIAHIRSKSNNFATYYADSVKDRFSISRDASENILFLQMNNLKTEDTAMYYCVRQGGDFPMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSS

SEQ ID NO: 7749 - protein, 855 aa, Artificial Sequence
  Synthetic Polypeptide encoding a CAR with  optional accessory module(s)
MALPVTALLLPLALLLHAARPDTQMTQSPSSVSASVGDRVTITCRTSQDISNYLNWYQQKPGKAPKLLIYNTSRLHSGVPSRFSGSGSGTDFTLTISSLQPEDFATYYCQQSNMFPYTFGQGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFNGYFMNWVRQAPGQGLERMGRINPNNGDSFYNQKFQGRVTMTRDTSTSTVYMELPSLRSEDTAVYYCAREGYYGGRGYALDYWGQGTLVTVSSTRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGVKQTLNFDLLKLAGDVESNPGPSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 7750 - skipped

SEQ ID NO: 7751 - RNA, 99 nt, Artificial Sequence
  Synthetic polynucleotide encoding gRNA targeting TRAC
  modified_base (1)..(3): 2' -O-methyl 3' phosphorothioate.
  modified_base (97)..(99): 2' -O-methyl 3' phosphorothioate.
caggguucuggauaucuguguuuuagagcuagaaauagcaaguuaaaauaaggcuaguccguuaucaacuugaaaaaguggcaccgagucggugcuuuu

SEQ ID NO: 7752 - RNA, 100 nt, Artificial Sequence
  Synthetic Polynucloetide encoding gRNA targeting TRBC
  modified_base (1)..(3): 2' -O-methyl 3' phosphorothioate
  modified_base (97)..(99): 2' -O-methyl 3' phosphorothioate
caaacacagcgaccucggguguuuuagagcuagaaauagcaaguuaaaauaaggcuaguccguuaucaacuugaaaaaguggcaccgagucggugcuuuu

SEQ ID NO: 7753 - RNA, 99 nt, Artificial Sequence
  Synthetic polynucleotide encoding gRNA against beta2M
  modified_base (1)..(3): 2' -O-methyl 3' phosphorothioate
  modified_base (97)..(99): 2' -O-methyl 3' phosphorothioate
ggccacggagcgagacaucuuuuuagagcuagaaauagcaaguuaaaauaaggcuaguccguuaucaacuugaaaaaguggcaccgagucggugcuuuu

SEQ ID NO: 7754 - DNA, 20 bp, Artificial Sequence
  Synthetic Polynucleotide
gagaatcaaaatcggtgaat

SEQ ID NO: 7755 - DNA, 21 bp, Artificial Sequence
  Synthetic Polynucleotide
gacaaaactgtgctagacatg

SEQ ID NO: 7756 - DNA, 20 bp, Artificial Sequence
  Synthetic Polynucleotide
ggctcaaacacagcgacctc

SEQ ID NO: 7757 - DNA, 20 bp, Artificial Sequence
  Synthetic Polynucleotide
ggctcaaacacagcgacctt

SEQ ID NO: 7758 - DNA, 20 bp, Artificial Sequence
  Synthetic Polynucleotide
ggctctcggagaatgacgag

SEQ ID NO: 7759 - DNA, 20 bp, Artificial Sequence
  Synthetic Polynucleotide
tcaatcgtaagtgtacccag

SEQ ID NO: 7760 - DNA, 20 bp, Artificial Sequence
  Synthetic Polynucleotide
ctgggtacacttacgattga

SEQ ID NO: 7761 - DNA, 20 bp, Artificial Sequence
  Synthetic Polynucleotide
gtcacggcccaaaacgacag

SEQ ID NO: 7762 - DNA, 20 bp, Artificial Sequence
  Synthetic Polynucleotide
tggccacttaatctctggag

SEQ ID NO: 7763 - DNA, 1920 bp, Artificial Sequence
  Synthetic Polynucleotide
atgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccaaacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagggaggcggagggtctggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgggactagaggagtgcaggtggagactatctccccaggagacgggcgcaccttccccaagcgcggccagacctgcgtggtgcactacaccgggatgcttgaagatggaaagaaagttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaa

SEQ ID NO: 7764 - DNA, 1488 bp, Artificial Sequence
  Synthetic Polynucleotide
atgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtgggaggcggagggtctggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgggactagaggagtgcaggtggagactatctccccaggagacgggcgcaccttccccaagcgcggccagacctgcgtggtgcactacaccgggatgcttgaagatggaaagaaagttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaa

SEQ ID NO: 7765 - DNA, 1416 bp, Artificial Sequence
  Synthetic Polynucleotide
atgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcggaggcggagggtctggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgggactagaggagtgcaggtggagactatctccccaggagacgggcgcaccttccccaagcgcggccagacctgcgtggtgcactacaccgggatgcttgaagatggaaagaaagttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaa

SEQ ID NO: 7766 - DNA, 1263 bp, Artificial Sequence
  Synthetic Polynucleotide
atgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggacggaggcggagggtctggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgggactagaggagtgcaggtggagactatctccccaggagacgggcgcaccttccccaagcgcggccagacctgcgtggtgcactacaccgggatgcttgaagatggaaagaaagttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaa

SEQ ID NO: 7767 - DNA, 1236 bp, Artificial Sequence
  Synthetic Polynucleotide
atgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 7768 - DNA, 564 bp, Artificial Sequence
  Synthetic Polynucleotide
atggctacctacgaggtgctgtgcgaggtggcaagaaagctgggcaccgacgacagagaagtggtgctgttcctgctgaacgtgttcatccctcagcctacactggcccagctgatcggtgcactgagagccctgaaagaggaaggccggctgacctttcctctgctggccgaatgcctgttcagagccggaagaagggatctgctgcgggacctgctgcatctggaccccagatttctggaaagacacctggccggcaccatgagctacttcagcccttaccagctgaccgtgctgcacgttgacggcgaactgtgcgccagagatattcggagcctgatcttcctgagcaaggacaccatcggcagccggtctacccctcagacatttctgcactgggtgtactgcatggaaaacctggacctgctcggccccacagatgtggatgccctgatgtccatgctgagaagcctgagcagagtggacctccagagacaggtgcagacactgatgggactgcacctgagcggacctagccacagccagcactacagacacacccct

SEQ ID NO: 7769 - DNA, 321 bp, Artificial Sequence
  Synthetic Polynucleotide encoding MTCP-1
atggctggcgaagatgtgggagcccctccagatcatctgtgggtgcaccaagagggcatctaccgggacgagtaccagagaacatgggtcgccgtggtggaagaggaaaccagcttcctgagagccagagtgcagcagatccaggtgccactgggagatgccgccagaccttctcatctgctgacaagccagctgcctctgatgtggcagctgtaccctgaggaacggtacatggacaacaacagcagactgtggcagattcagcaccacctgatggtccgaggcgtgcaagagctgctgctgaagctgctgcctgacgat

SEQ ID NO: 7770 - DNA, 1014 bp, Artificial Sequence
  Synthetic Polynucleotide encoding CMV-141
atgtgcagaagagagagcctgagaaccctgccttggctgttctgggtgctgctgagctgccctagactgctggaatactcctccagcagcttcccttttgccaccgccgacattgccgagaagatgtgggccgagaactacgagacaacaagccccgctcctgtgctggtggctgaaggcgagcaagtgacaatcccctgcaccgtgatgacccacagctggcctatggtgtccatccgggccagattctgtagaagccacgatggcagcgacgagctgatcctggatgccgtgaaaggccacagactgatgaacggcctccagtacagactgccctacgccacctggaacttcagccagctgcacctgggacagattttcagcctgaccttcaacgtgtccaccgacaccgccgggatgtacgagtgcgtgctgagaaattacagccacggcctgattatgcagcgcttcgtgatcctgacacagctggaaaccctgagcagacccgatgagccttgctgcacaccagctctgggcagatacagcctgggcgaccaaatctggtcccctacaccttggcggctgagaaaccacgactgcggcatgtacagaggcttccagcggaactacttctacatcggcagagccgacgccgaggactgttggaaacctgcctgtcctgacgaggaacccgacagatgttggaccgtgatccagagatacaggctgcccggcgactgctacagaagccaacctcatcctcctaagtttctgcccgtgacaccagcacctccagccgatattgataccggcatgagcccttgggccaccagaggaattgccgcctttctcggcttctggtctatcttcaccgtgtgctttctgtgctacctgtgttacctccagtgctgcggcagatggtgtcccacacctggaagaggaagaagaggcggcgagggctatagaaggctgcccacctacgatagctaccccggcgtgaagaagatgaagcgg

SEQ ID NO: 7771 - DNA, 2940 bp, Artificial Sequence
  Synthetic Polynucleotide
ggacttgtcctttaaaaccccttctaggccaggtgctgtggctcacgcctgtaatcccaacactttgggaggccaaagtgggtagatggcttaagcccgggagttccaagaccagcctgggcaacagaaagacaacaaaaatacccccaaacccccccgtctaccagcatccaatctgggacctcaggttcctgtccttggcgtgccttttcagtctcctttaatctagaacagttcccctgcctttctgagctgtttgtgaagttcacagttttgaacagtgcagggtagttccattgtattattactattattttcaagacagggtcttgctctaccgtccaggctggagtgcagtggcataatctcggcttactgtaccttccgcctcttggtctcaagcgatcctcccaggtagctgggactataggcgcaggccagcacacctggctaatttttgcatttttggtagaggtggcgttttcctatgttgcccgggctggtcttgaactcctgagctcaagcgatcctcctgccttggcttctcaaagtgttgggattatgggcgtgagccaccgcgtctggccgcgattttattataaacattaaaaatactagcttttaggaaaacgatattaactgcctggtgaccagcccaccaaagcctgctttagagttgacggcctcaggagtcctcacacagccttggaagaccccattccaggcctgtgatgcgagggagggaaggaagggggtagagttggaagcaggcagcaccgtggctggactggcatgaggtggtttctccagcaaaagctccctttcctcaggaggaagctggcccagttgcaggtggcctatcaccagctcttccaagaatacgacaaccacatcaagagcagcgtggtgggcagtgagcggaagcgagtgagtgcgaccactggggctctagggctggccttgcctcttcctctccccgtggccctgaaccttgagaatgggtagacctgccttagacttgccttagacctgtgtcaggctgcagctgcgacagctcagggaagctgtggggagatggcaaccccaggatgttgctctcaggagtgtcagcaggccatcttaatggggggctgggccagagccttggggtgctccctctgtggggctggggacgtcttgtctccatggacattccctcttgccagccatcgccatctggcacctggctcagcttcccccaagccaaggtaagcccgacagcatttccaccccagtgttggctgggagccttttcctagtttgtcctcatcagacctaagctggggtgcagtttgctagtgatcacattttagcaggacaccgtcaatcgtaagtgtacccagaggagatttataaggacaaagcctgaagccaggtcacatggggaagagttagctacaaaactggccacttaatctctggaggggggcgttggtggggtgtgtctgtgtgtgtctcagggggctggagatgcctgcgtgggaggagtgcacctctgaccaggtggcagagtggaaggactgagggctctcagctgagctgtgcacatggcgggcacaggaccggctggctgtgagtgggtgtggcctgtggcctgtgaagggtgggaggagggctgtggagctggggattctgggaagggaatgtcggcccagctgggaggttgtaccagatgacctcagcggcctcttcagtcctgaaaaaaacctcagcatctcctctgtcgttttgggccgtgacaggacgcagccatctccctgtgcacgctgagatcctgcaatgggccctcaaatcaggggctggcatcacccagcctggtcagccagggccactctttcatccttctcagttcttctcagccagcctcgccctgggctgacgaggctccgtcagctccccttgcccgtccttagggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggtgagggccctcctctctgacccaccctggcactgggacctggagagtctctttggcgtcttttttttttttttttgcttttgctttttgagattgagttttgctcttgttgcccaggctggagtgccactagtggcacgatcttggctcactgcaacctctgcctcccgggttcaaacaattctcttgcctcagcctcctgagtagctgggattacaggcgcctgccgccatgcccgtctaatttttgtatttttagtagagacagggtttcaccatgttggcccagctggtctcgaacttctggcctcaggtgatctgcccaccgcagtctctcaaagttctgggattacaggcgtgagccaccgcacccggcctctttggcatcattttgtagtggcctttcgtaagcttctgagccacttgtgctgctccttagacctctcggtgagcttggcattactcgccgacgtatctgtttcctctgcgccgctgggggctctgggaggacagcagtgggttctgctttgttcctgtggtgcctggcgcagtgcctggtgggtggctggcttgtggcgggcacatccctttctgttggatttgccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggtgggcctctgagagcgtgcccgtgtgagcagtgggtgcgacactggggggtcgccagtggtgaccccgcagtgggtgcgacactggggggttgc

SEQ ID NO: 7772 - DNA, 2919 bp, Artificial Sequence
  Synthetic Polynucleotide
ggacttgtcctttaaaaccccttctaggccaggtgctgtggctcacgcctgtaatcccaacactttgggaggccaaagtgggtagatggcttaagcccgggagttccaagaccagcctgggcaacagaaagacaacaaaaatacccccaaacccccccgtctaccagcatccaatctgggacctcaggttcctgtccttggcgtgccttttcagtctcctttaatctagaacagttcccctgcctttctgagctgtttgtgaagttcacagttttgaacagtgcagggtagttccattgtattattactattattttcaagacagggtcttgctctaccgtccaggctggagtgcagtggcataatctcggcttactgtaccttccgcctcttggtctcaagcgatcctcccaggtagctgggactataggcgcaggccagcacacctggctaatttttgcatttttggtagaggtggcgttttcctatgttgcccgggctggtcttgaactcctgagctcaagcgatcctcctgccttggcttctcaaagtgttgggattatgggcgtgagccaccgcgtctggccgcgattttattataaacattaaaaatactagcttttaggaaaacgatattaactgcctggtgaccagcccaccaaagcctgctttagagttgacggcctcaggagtcctcacacagccttggaagaccccattccaggcctgtgatgcgagggagggaaggaagggggtagagttggaagcaggcagcaccgtggctggactggcatgaggtggtttctccagcaaaagctccctttcctcaggaggaagctggcccagttgcaggtggcctatcaccagctcttccaagaatacgacaaccacatcaagagcagccgagtgagtgcgaccactggggctctagggctggccttgcctcttcctctccccgtggccctgaaccttgagaatgggtagacctgccttagacttgccttagacctgtgtcaggctgcagctgcgacagctcagggaagctgtggggagatggcaaccccaggatgttgctctcaggagtgtcagcaggccatcttaatggggggctgggccagagccttggggtgctccctctgtggggctggggacgtcttgtctccatggacattccctcttgccagccatcgccatctggcacctggctcagcttcccccaagccaaggtaagcccgacagcatttccaccccagtgttggctgggagccttttcctagtttgtcctcatcagacctaagctggggtgcagtttgctagtgatcacattttagcaggacaccgtcaatcgtaagtgtacccagaggagatttataaggacaaagcctgaagccaggtcacatggggaagagttagctacaaaactggccacttaatctctggaggggggcgttggtggggtgtgtctgtgtgtgtctcagggggctggagatgcctgcgtgggaggagtgcacctctgaccaggtggcagagtggaaggactgagggctctcagctgagctgtgcacatggcgggcacaggaccggctggctgtgagtgggtgtggcctgtggcctgtgaagggtgggaggagggctgtggagctggggattctgggaagggaatgtcggcccagctgggaggttgtaccagatgacctcagcggcctcttcagtcctgaaaaaaacctcagcatctcctctgtcgttttgggccgtgacaggacgcagccatctccctgtgcacgctgagatcctgcaatgggccctcaaatcaggggctggcatcacccagcctggtcagccagggccactctttcatccttctcagttcttctcagccagcctcgccctgggctgacgaggctccgtcagctccccttgcccgtccttagggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggtgagggccctcctctctgacccaccctggcactgggacctggagagtctctttggcgtcttttttttttttttttgcttttgctttttgagattgagttttgctcttgttgcccaggctggagtgccactagtggcacgatcttggctcactgcaacctctgcctcccgggttcaaacaattctcttgcctcagcctcctgagtagctgggattacaggcgcctgccgccatgcccgtctaatttttgtatttttagtagagacagggtttcaccatgttggcccagctggtctcgaacttctggcctcaggtgatctgcccaccgcagtctctcaaagttctgggattacaggcgtgagccaccgcacccggcctctttggcatcattttgtagtggcctttcgtaagcttctgagccacttgtgctgctccttagacctctcggtgagcttggcattactcgccgacgtatctgtttcctctgcgccgctgggggctctgggaggacagcagtgggttctgctttgttcctgtggtgcctggcgcagtgcctggtgggtggctggcttgtggcgggcacatccctttctgttggatttgccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggtgggcctctgagagcgtgcccgtgtgagcagtgggtgcgacactggggggtcgccagtggtgaccccgcagtgggtgcgacactggggggttgc

SEQ ID NO: 7773 - DNA, 4010 bp, Artificial Sequence
  Synthetic Polynucleotide
ggatccagctggatgtctgcattgccgaggccaccagggctggctcagcaactgtcggggaatcaccagggtctgagaaatcttgtgcgcatgtgaggggctgtgggagcagagaaccactgggtgggaaattctaatccccaccctgctggaaactctctgggtggccccaacatgctaatcctccggcaaacctctgtttcctcctcaaaaggcaggaggtcggaaagaataaacaatgagagtcacattaaaaacacaaaatcctacggaaatactgaagaatgagtctcagcactaaggaaaagcctccagcagctcctgctttctgagggtgaaggatagacgctgtggctctgcatgactcactagcactctatcacggccatattctggcagggtcagtggctccaactaacatttgtttggtactttacagtttattaaatagatgtttatatggagaagctctcatttctttctcagaagagcctggctaggaaggtggatgaggcaccatattcattttgcaggtgaaattcctgagatgtaaggagctgctgtgacttgctcaaggccttatatcgagtaaacggtagcgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatgtgaagcagaccctgaatttcgacctgctgaagctggctggcgacgtggaatccaacccaggccctatggccttaccagtgaccgccttgctcctgccgctggccttgctgctccacgccgccaggccggacgtggtcatgacacagagcccttctagcctgtctgccagcgtgggcgacagagtgaccatcacctgtatggcctccgaggacatctacatccggctggcctggtatcagcagaagcctggaaacgcccctaagctgctgatctacgccgccacctctctggaaacaggcgtgccaagcagattttccggcagcggctctggcaccgatttcaccctgacaatatccagcctccagcctgaggacttcgccacctactactgccagcagtattggagcagcccctggacatttggcggaggcaccaaggtggaaatcaaaggcggaggcggaagtggaggcggaggatctggcggcggaggctctcaggttcagctgcaagagtctggccccggactggtcaagcctagccaaacactgagcctgacctgtaccgtgtccggctacagcatcaccagcgactacacctggaactggatcagacagcctcctggcaacggactggaatggatcggctacatcacctacagcggcagcaccagctacaaccccagcctgaaaagccgggtgctgatctccgtggacaccagcaagaatcaggtgtccctgaagctgagcagcgtgacagccgctgataccgccgtgtactactgtgccagactggggagaagatacacaatggactactggggccagggcaccaccgtgacagtttcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactgaccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggaattaattctaaaatacagcatagcaaaactttaacctccaaatcaagcctctacttgaatccttttctgagggatgaataaggcataggcatcaggggctgttgccaatgtgcattagctgtttgcagcctcaccttctttcatggagtttaagatatagtgtattttcccaaggtttgaactagctcttcatttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagcttctagcttatcctgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagccaccttcaggacaaaagtcagggaagggctctctgaagaaatgctacttgaagataccagccctaccaagggcagggagaggaccctatagaggcctgggaca

SEQ ID NO: 7774 - DNA, 4592 bp, Artificial Sequence
  Synthetic Polynucleotide
ggatccagctggatgtctgcattgccgaggccaccagggctggctcagcaactgtcggggaatcaccagggtctgagaaatcttgtgcgcatgtgaggggctgtgggagcagagaaccactgggtgggaaattctaatccccaccctgctggaaactctctgggtggccccaacatgctaatcctccggcaaacctctgtttcctcctcaaaaggcaggaggtcggaaagaataaacaatgagagtcacattaaaaacacaaaatcctacggaaatactgaagaatgagtctcagcactaaggaaaagcctccagcagctcctgctttctgagggtgaaggatagacgctgtggctctgcatgactcactagcactctatcacggccatattctggcagggtcagtggctccaactaacatttgtttggtactttacagtttattaaatagatgtttatatggagaagctctcatttctttctcagaagagcctggctaggaaggtggatgaggcaccatattcattttgcaggtgaaattcctgagatgtaaggagctgctgtgacttgctcaaggccttatatcgagtaaacggtagcgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatgtgaagcagaccctgaatttcgacctgctgaagctggctggcgacgtggaatccaacccaggccctatggccttaccagtgaccgccttgctcctgccgctggccttgctgctccacgccgccaggccggacgtggtcatgacacagagcccttctagcctgtctgccagcgtgggcgacagagtgaccatcacctgtatggcctccgaggacatctacatccggctggcctggtatcagcagaagcctggaaacgcccctaagctgctgatctacgccgccacctctctggaaacaggcgtgccaagcagattttccggcagcggctctggcaccgatttcaccctgacaatatccagcctccagcctgaggacttcgccacctactactgccagcagtattggagcagcccctggacatttggcggaggcaccaaggtggaaatcaaaggcggaggcggaagtggaggcggaggatctggcggcggaggctctcaggttcagctgcaagagtctggccccggactggtcaagcctagccaaacactgagcctgacctgtaccgtgtccggctacagcatcaccagcgactacacctggaactggatcagacagcctcctggcaacggactggaatggatcggctacatcacctacagcggcagcaccagctacaaccccagcctgaaaagccgggtgctgatctccgtggacaccagcaagaatcaggtgtccctgaagctgagcagcgtgacagccgctgataccgccgtgtactactgtgccagactggggagaagatacacaatggactactggggccagggcaccaccgtgacagtttcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaacagggccaagcgatctggatctggagcaacaaacttctcactactcaaacaagcaggtgacgtggaggagaatcccgggccttctagtatggactggatttggcgcatccttttccttgtcggcgctgctaccggcgcgcattccttcgaaggcggactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctgaccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggaattaattctaaaatacagcatagcaaaactttaacctccaaatcaagcctctacttgaatccttttctgagggatgaataaggcataggcatcaggggctgttgccaatgtgcattagctgtttgcagcctcaccttctttcatggagtttaagatatagtgtattttcccaaggtttgaactagctcttcatttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagcttctagcttatcctgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagccaccttcaggacaaaagtcagggaagggctctctgaagaaatgctacttgaagataccagccctaccaagggcagggagaggaccctatagaggcctgggaca

SEQ ID NO: 7775 - DNA, 5641 bp, Artificial Sequence
  Synthetic Polynucleotide
  misc_feature (3633)..(3633): n is a, c, g, or t
ggatccagctggatgtctgcattgccgaggccaccagggctggctcagcaactgtcggggaatcaccagggtctgagaaatcttgtgcgcatgtgaggggctgtgggagcagagaaccactgggtgggaaattctaatccccaccctgctggaaactctctgggtggccccaacatgctaatcctccggcaaacctctgtttcctcctcaaaaggcaggaggtcggaaagaataaacaatgagagtcacattaaaaacacaaaatcctacggaaatactgaagaatgagtctcagcactaaggaaaagcctccagcagctcctgctttctgagggtgaaggatagacgctgtggctctgcatgactcactagcactctatcacggccatattctggcagggtcagtggctccaactaacatttgtttggtactttacagtttattaaatagatgtttatatggagaagctctcatttctttctcagaagagcctggctaggaaggtggatgaggcaccatattcattttgcaggtgaaattcctgagatgtaaggagctgctgtgacttgctcaaggccttatatcgagtaaacggtagcgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatgtgaagcagaccctgaatttcgacctgctgaagctggctggcgacgtggaatccaacccaggccctatggccttaccagtgaccgccttgctcctgccgctggccttgctgctccacgccgccaggccggacgtggtcatgacacagagcccttctagcctgtctgccagcgtgggcgacagagtgaccatcacctgtatggcctccgaggacatctacatccggctggcctggtatcagcagaagcctggaaacgcccctaagctgctgatctacgccgccacctctctggaaacaggcgtgccaagcagattttccggcagcggctctggcaccgatttcaccctgacaatatccagcctccagcctgaggacttcgccacctactactgccagcagtattggagcagcccctggacatttggcggaggcaccaaggtggaaatcaaaggcggaggcggaagtggaggcggaggatctggcggcggaggctctcaggttcagctgcaagagtctggccccggactggtcaagcctagccaaacactgagcctgacctgtaccgtgtccggctacagcatcaccagcgactacacctggaactggatcagacagcctcctggcaacggactggaatggatcggctacatcacctacagcggcagcaccagctacaaccccagcctgaaaagccgggtgctgatctccgtggacaccagcaagaatcaggtgtccctgaagctgagcagcgtgacagccgctgataccgccgtgtactactgtgccagactggggagaagatacacaatggactactggggccagggcaccaccgtgacagtttcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaacagggccaagcgatctggatctggagcaacaaacttctcactactcaaacaagcaggtgacgtggaggagaatcccgggccttctagtatggactggatttggcgcatccttttccttgtcggcgctgctaccggcgcgcattccgatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagccaccttcaggacaaaagtcagggaagggctctctgaagaaatgctacttgaagataccagccctaccaagggcagggagaggaccctatagaggcctgggacantttttttttttttttttttttgagatggagttttgctcttgttgcccaggctggagtgcaatggtgcatcttggctcactacaacctctgcctcccaggttcaagtgattctcctgcctcagcctcccaagtagctgggattacaggcacccaccaccatgcccggctaattttttgtatttttagtagagacagggtttcactatgttggccaggctggtctcgaactcctgacctcaggtgatccacccgcttcagcctcccaaagtgctgggattacaggcgtgagccaccacacccggcctgcttttcttaaagatcaatctgagtgctgtacggagagtgggttgtaagccaagagtagaagcagaaagggagcagttgcagcagagagatgatggaggcctgggcagggtggtggcagggaggtaaccaacaccattcaggtttcaaaggtagaaccatgcagggatgagaaagcaaagaggggatcaaggaaggcagctggattttggcctgagcagctgagtcaatgatagtgccgtttactaagaagaaaccaaggaaaaaatttggggtgcagggatcaaaactttttggaacatatgaaagtacgtgtttatactctttatggcccttgtcactatgtatgcctcgctgcctccattggactctagaatgaagccaggcaagagcagggtctatgtgtgatggcacatgtggccagggtcatgcaacatgtactttgtacaaacagtgtatattgagtaaatagaaatggtgtccaggagccgaggtatcggtcctgccagggccaggggctctccctagcaggtgctcatatgctgtaagttccctccagatctctccacaaggaggcatggaaaggctgtagttgttcacctgcccaagaactaggaggtctggggtgggagagtcagcctgctctggatgctgaaagaatgtctgtttttccttttagaaagttcctgtgatgtcaagctggtcgagaaaagctttgaaacaggtaagacaggggtctagcctgggtttgcacaggattgcggaagtgatgaacccgcaataaccctgcctggatgagggagtgggaagaaattagtagatgtgggaatgaatgatgaggaatggaaacagcggttcaagacctgcccagagctgggtggggtctctcctgaatccctctcaccgtctctgactttccgttctaagcactttgaggatgagtttctagcttcaatagaccaaggactctctcctaggcctctgtattcctttcaacagctccactgtcaagagagccagagagagcttctgggtggcccagctgtgaaatttctgagtcccttagggatagccctaaacgaaccagatcatcctgaggacagccaagaggttttgccttctttcaagacaagcaacagtactcacataggctgtgggcaatggtcctgtctctcaagaatcccctgccactcctcacacccaccctgggcccatattcatttccatttgagttgttcttattgagtcatccttcctgtggcagcggaactcactaaggggcccatctggacccgaggtattgtgaagataaattctgagcacctaccccatccccagaagggctcagaaataaaataagagccaagtctagtcggtgtttcctgtcttgaaacacaatactgttggccctggaagaatgcacagaatctgtttgtaaggggatatgcacagaagctgcaagggacaggaggtgcaggagctgcaggcctcccccacccagcctgctctgccttggggaaaaccgtgggtgtgtcctgcaggccatgcaggcctgggacatgcaagcccataaccgctgtggcctcttggttttacagatacgaacctaaactttcaaaacctgtcagtgattgggttccgaatcctcctcctgaaagtggccgggtttaatctgctcatgacgctgcggctgtggtccagctga

SEQ ID NO: 7776 - DNA, 3980 bp, Artificial Sequence
  Synthetic Polynucleotide
ggatccagctggatgtctgcattgccgaggccaccagggctggctcagcaactgtcggggaatcaccagggtctgagaaatcttgtgcgcatgtgaggggctgtgggagcagagaaccactgggtgggaaattctaatccccaccctgctggaaactctctgggtggccccaacatgctaatcctccggcaaacctctgtttcctcctcaaaaggcaggaggtcggaaagaataaacaatgagagtcacattaaaaacacaaaatcctacggaaatactgaagaatgagtctcagcactaaggaaaagcctccagcagctcctgctttctgagggtgaaggatagacgctgtggctctgcatgactcactagcactctatcacggccatattctggcagggtcagtggctccaactaacatttgtttggtactttacagtttattaaatagatgtttatatggagaagctctcatttctttctcagaagagcctggctaggaaggtggatgaggcaccatattcattttgcaggtgaaattcctgagatgtaaggagctgctgtgacttgctcaaggccttatatcgagtaaacggtagcgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatgtgaagcagaccctgaatttcgacctgctgaagctggctggcgacgtggaatccaacccaggccctatggccttaccagtgaccgccttgctcctgccgctggccttgctgctccacgccgccaggccggacgtggtcatgacacagagcccttctagcctgtctgccagcgtgggcgacagagtgaccatcacctgtatggcctccgaggacatctacatccggctggcctggtatcagcagaagcctggaaacgcccctaagctgctgatctacgccgccacctctctggaaacaggcgtgccaagcagattttccggcagcggctctggcaccgatttcaccctgacaatatccagcctccagcctgaggacttcgccacctactactgccagcagtattggagcagcccctggacatttggcggaggcaccaaggtggaaatcaaaggcggaggcggaagtggaggcggaggatctggcggcggaggctctcaggttcagctgcaagagtctggccccggactggtcaagcctagccaaacactgagcctgacctgtaccgtgtccggctacagcatcaccagcgactacacctggaactggatcagacagcctcctggcaacggactggaatggatcggctacatcacctacagcggcagcaccagctacaaccccagcctgaaaagccgggtgctgatctccgtggacaccagcaagaatcaggtgtccctgaagctgagcagcgtgacagccgctgataccgccgtgtactactgtgccagactggggagaagatacacaatggactactggggccagggcaccaccgtgacagtttcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtgaccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggaattaattctaaaatacagcatagcaaaactttaacctccaaatcaagcctctacttgaatccttttctgagggatgaataaggcataggcatcaggggctgttgccaatgtgcattagctgtttgcagcctcaccttctttcatggagtttaagatatagtgtattttcccaaggtttgaactagctcttcatttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagcttctagcttatcctgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagccaccttcaggacaaaagtcagggaagggctctctgaagaaatgctacttgaagataccagccctaccaagggcagggagaggaccctatagaggcctgggaca

SEQ ID NO: 7777 - DNA, 4562 bp, Artificial Sequence
  Synthetic Polynucleotide
ggatccagctggatgtctgcattgccgaggccaccagggctggctcagcaactgtcggggaatcaccagggtctgagaaatcttgtgcgcatgtgaggggctgtgggagcagagaaccactgggtgggaaattctaatccccaccctgctggaaactctctgggtggccccaacatgctaatcctccggcaaacctctgtttcctcctcaaaaggcaggaggtcggaaagaataaacaatgagagtcacattaaaaacacaaaatcctacggaaatactgaagaatgagtctcagcactaaggaaaagcctccagcagctcctgctttctgagggtgaaggatagacgctgtggctctgcatgactcactagcactctatcacggccatattctggcagggtcagtggctccaactaacatttgtttggtactttacagtttattaaatagatgtttatatggagaagctctcatttctttctcagaagagcctggctaggaaggtggatgaggcaccatattcattttgcaggtgaaattcctgagatgtaaggagctgctgtgacttgctcaaggccttatatcgagtaaacggtagcgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatgtgaagcagaccctgaatttcgacctgctgaagctggctggcgacgtggaatccaacccaggccctatggccttaccagtgaccgccttgctcctgccgctggccttgctgctccacgccgccaggccggacgtggtcatgacacagagcccttctagcctgtctgccagcgtgggcgacagagtgaccatcacctgtatggcctccgaggacatctacatccggctggcctggtatcagcagaagcctggaaacgcccctaagctgctgatctacgccgccacctctctggaaacaggcgtgccaagcagattttccggcagcggctctggcaccgatttcaccctgacaatatccagcctccagcctgaggacttcgccacctactactgccagcagtattggagcagcccctggacatttggcggaggcaccaaggtggaaatcaaaggcggaggcggaagtggaggcggaggatctggcggcggaggctctcaggttcagctgcaagagtctggccccggactggtcaagcctagccaaacactgagcctgacctgtaccgtgtccggctacagcatcaccagcgactacacctggaactggatcagacagcctcctggcaacggactggaatggatcggctacatcacctacagcggcagcaccagctacaaccccagcctgaaaagccgggtgctgatctccgtggacaccagcaagaatcaggtgtccctgaagctgagcagcgtgacagccgctgataccgccgtgtactactgtgccagactggggagaagatacacaatggactactggggccagggcaccaccgtgacagtttcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagagggccaagcgatctggatctggagcaacaaacttctcactactcaaacaagcaggtgacgtggaggagaatcccgggccttctagtatggactggatttggcgcatccttttccttgtcggcgctgctaccggcgcgcattccttcgaaggcggactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctgaccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggaattaattctaaaatacagcatagcaaaactttaacctccaaatcaagcctctacttgaatccttttctgagggatgaataaggcataggcatcaggggctgttgccaatgtgcattagctgtttgcagcctcaccttctttcatggagtttaagatatagtgtattttcccaaggtttgaactagctcttcatttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagcttctagcttatcctgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagccaccttcaggacaaaagtcagggaagggctctctgaagaaatgctacttgaagataccagccctaccaagggcagggagaggaccctatagaggcctgggaca

SEQ ID NO: 7778 - DNA, 5611 bp, Artificial Sequence
  Synthetic Polynucleotide
  misc_feature (3603)..(3603): n is a, c, g, or t
ggatccagctggatgtctgcattgccgaggccaccagggctggctcagcaactgtcggggaatcaccagggtctgagaaatcttgtgcgcatgtgaggggctgtgggagcagagaaccactgggtgggaaattctaatccccaccctgctggaaactctctgggtggccccaacatgctaatcctccggcaaacctctgtttcctcctcaaaaggcaggaggtcggaaagaataaacaatgagagtcacattaaaaacacaaaatcctacggaaatactgaagaatgagtctcagcactaaggaaaagcctccagcagctcctgctttctgagggtgaaggatagacgctgtggctctgcatgactcactagcactctatcacggccatattctggcagggtcagtggctccaactaacatttgtttggtactttacagtttattaaatagatgtttatatggagaagctctcatttctttctcagaagagcctggctaggaaggtggatgaggcaccatattcattttgcaggtgaaattcctgagatgtaaggagctgctgtgacttgctcaaggccttatatcgagtaaacggtagcgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatgtgaagcagaccctgaatttcgacctgctgaagctggctggcgacgtggaatccaacccaggccctatggccttaccagtgaccgccttgctcctgccgctggccttgctgctccacgccgccaggccggacgtggtcatgacacagagcccttctagcctgtctgccagcgtgggcgacagagtgaccatcacctgtatggcctccgaggacatctacatccggctggcctggtatcagcagaagcctggaaacgcccctaagctgctgatctacgccgccacctctctggaaacaggcgtgccaagcagattttccggcagcggctctggcaccgatttcaccctgacaatatccagcctccagcctgaggacttcgccacctactactgccagcagtattggagcagcccctggacatttggcggaggcaccaaggtggaaatcaaaggcggaggcggaagtggaggcggaggatctggcggcggaggctctcaggttcagctgcaagagtctggccccggactggtcaagcctagccaaacactgagcctgacctgtaccgtgtccggctacagcatcaccagcgactacacctggaactggatcagacagcctcctggcaacggactggaatggatcggctacatcacctacagcggcagcaccagctacaaccccagcctgaaaagccgggtgctgatctccgtggacaccagcaagaatcaggtgtccctgaagctgagcagcgtgacagccgctgataccgccgtgtactactgtgccagactggggagaagatacacaatggactactggggccagggcaccaccgtgacagtttcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagagggccaagcgatctggatctggagcaacaaacttctcactactcaaacaagcaggtgacgtggaggagaatcccgggccttctagtatggactggatttggcgcatccttttccttgtcggcgctgctaccggcgcgcattccgatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagccaccttcaggacaaaagtcagggaagggctctctgaagaaatgctacttgaagataccagccctaccaagggcagggagaggaccctatagaggcctgggacantttttttttttttttttttttgagatggagttttgctcttgttgcccaggctggagtgcaatggtgcatcttggctcactacaacctctgcctcccaggttcaagtgattctcctgcctcagcctcccaagtagctgggattacaggcacccaccaccatgcccggctaattttttgtatttttagtagagacagggtttcactatgttggccaggctggtctcgaactcctgacctcaggtgatccacccgcttcagcctcccaaagtgctgggattacaggcgtgagccaccacacccggcctgcttttcttaaagatcaatctgagtgctgtacggagagtgggttgtaagccaagagtagaagcagaaagggagcagttgcagcagagagatgatggaggcctgggcagggtggtggcagggaggtaaccaacaccattcaggtttcaaaggtagaaccatgcagggatgagaaagcaaagaggggatcaaggaaggcagctggattttggcctgagcagctgagtcaatgatagtgccgtttactaagaagaaaccaaggaaaaaatttggggtgcagggatcaaaactttttggaacatatgaaagtacgtgtttatactctttatggcccttgtcactatgtatgcctcgctgcctccattggactctagaatgaagccaggcaagagcagggtctatgtgtgatggcacatgtggccagggtcatgcaacatgtactttgtacaaacagtgtatattgagtaaatagaaatggtgtccaggagccgaggtatcggtcctgccagggccaggggctctccctagcaggtgctcatatgctgtaagttccctccagatctctccacaaggaggcatggaaaggctgtagttgttcacctgcccaagaactaggaggtctggggtgggagagtcagcctgctctggatgctgaaagaatgtctgtttttccttttagaaagttcctgtgatgtcaagctggtcgagaaaagctttgaaacaggtaagacaggggtctagcctgggtttgcacaggattgcggaagtgatgaacccgcaataaccctgcctggatgagggagtgggaagaaattagtagatgtgggaatgaatgatgaggaatggaaacagcggttcaagacctgcccagagctgggtggggtctctcctgaatccctctcaccgtctctgactttccgttctaagcactttgaggatgagtttctagcttcaatagaccaaggactctctcctaggcctctgtattcctttcaacagctccactgtcaagagagccagagagagcttctgggtggcccagctgtgaaatttctgagtcccttagggatagccctaaacgaaccagatcatcctgaggacagccaagaggttttgccttctttcaagacaagcaacagtactcacataggctgtgggcaatggtcctgtctctcaagaatcccctgccactcctcacacccaccctgggcccatattcatttccatttgagttgttcttattgagtcatccttcctgtggcagcggaactcactaaggggcccatctggacccgaggtattgtgaagataaattctgagcacctaccccatccccagaagggctcagaaataaaataagagccaagtctagtcggtgtttcctgtcttgaaacacaatactgttggccctggaagaatgcacagaatctgtttgtaaggggatatgcacagaagctgcaagggacaggaggtgcaggagctgcaggcctcccccacccagcctgctctgccttggggaaaaccgtgggtgtgtcctgcaggccatgcaggcctgggacatgcaagcccataaccgctgtggcctcttggttttacagatacgaacctaaactttcaaaacctgtcagtgattgggttccgaatcctcctcctgaaagtggccgggtttaatctgctcatgacgctgcggctgtggtccagctga

SEQ ID NO: 7779 - DNA, 7172 bp, Artificial Sequence
  Synthetic Polynucleotide
cccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagcttggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccggggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgataagctaattcacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttgggaattagcttgatcgattagtccaatttgttaaagacaggatatcagtggtccaggctctagttttgactcaacaatatcaccagctgaagcctatagagtacgagccatagatagaataaaagattttatttagtctccagaaaaaggggggaatgaaagaccccacctgtaggtttggcaagctaggatcaaggttaggaacagagagacagcagaatatgggccaaacaggatatctgtggtaagcagttcctgccccggctcagggccaagaacagttggaacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaatgaccctgtgccttatttgaactaaccaatcagttcgcttctcgcttctgttcgcgcgcttctgctccccgagctcaataaaagagcccacaacccctcactcggcgcgatctagatctcgaatcgaattcgtcgactgatccgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcggatcaaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggttt

SEQ ID NO: 7780 - DNA, 7181 bp, Artificial Sequence
  Synthetic Polynucleotide
cccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagcttggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccggggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgataagctaattcacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttgggaattagcttgatcgattagtccaatttgttaaagacaggatatcagtggtccaggctctagttttgactcaacaatatcaccagctgaagcctatagagtacgagccatagatagaataaaagattttatttagtctccagaaaaaggggggaatgaaagaccccacctgtaggtttggcaagctaggatcaaggttaggaacagagagacagcagaatatgggccaaacaggatatctgtggtaagcagttcctgccccggctcagggccaagaacagttggaacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaatgaccctgtgccttatttgaactaaccaatcagttcgcttctcgcttctgttcgcgcgcttctgctccccgagctcaataaaagagcccacaacccctcactcggcgcgatctagatctcgaatcgaattcgccgctagcgtcgactgatccgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcggatcaaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggttt

SEQ ID NO: 7781 - DNA, 2568 bp, Artificial Sequence
  Synthetic Polynucleotide
atggagcggcccccggggctgcggccgggcgcgggcgggccctgggagatgcgggagcggctgggcaccggcggcttcgggaacgtctgtctgtaccagcatcgggaacttgatctcaaaatagcaattaagtcttgtcgcctagagctaagtaccaaaaacagagaacgatggtgccatgaaatccagattatgaagaagttgaaccatgccaatgttgtaaaggcctgtgatgttcctgaagaattgaatattttgattcatgatgtgcctcttctagcaatggaatactgttctggaggagatctccgaaagctgctcaacaaaccagaaaattgttgtggacttaaagaaagccagatactttctttactaagtgatatagggtctgggattcgatatttgcatgaaaacaaaattatacatcgagatctaaaacctgaaaacatagttcttcaggatgttggtggaaagataatacataaaataattgatctgggatatgccaaagatgttgatcaaggaagtctgtgtacatcttttgtgggaacactgcagtatctggccccagagctctttgagaataagccttacacagccactgttgattattggagctttgggaccatggtatttgaatgtattgctggatataggccttttttgcatcatctgcagccatttacctggcatgagaagattaagaagaaggatccaaagtgtatatttgcatgtgaagagatgtcaggagaagttcggtttagtagccatttacctcaaccaaatagcctttgtagtttaatagtagaacccatggaaaactggctacagttgatgttgaattgggaccctcagcagagaggaggacctgttgaccttactttgaagcagccaagatgttttgtattaatggatcacattttgaatttgaagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttagaggctgtgatagctatatggtttatttgtttgataaaagtaaaactgtatatgaagggccatttgcttccagaagtttatctgattgtgtaaattatattgtacaggacagcaaaatacagcttccaattatacagctgcgtaaagtgtgggctgaagcagtgcactatgtgtctggactaaaagaagactatagcaggctctttcagggacaaagggcagcaatgttaagtcttcttagatataatgctaacttaacaaaaatgaagaacactttgatctcagcatcacaacaactgaaagctaaattggagttttttcacaaaagcattcagcttgacttggagagatacagcgagcagatgacgtatgggatatcttcagaaaaaatgctaaaagcatggaaagaaatggaagaaaaggccatccactatgctgaggttggtgtcattggatacctggaggatcagattatgtctttgcatgctgaaatcatggggctacagaagagcccctatggaagacgtcagggagacttgatggaatctctggaacagcgtgccattgatctatataagcagttaaaacacagaccttcagatcactcctacagtgacagcacagagatggtgaaaatcattgtgcacactgtgcagagtcaggaccgtgtgctcaaggagctgtttggtcatttgagcaagttgttgggctgtaagcagaagattattgatctactccctaaggtggaagtggccctcagtaatatcaaagaagctgacaatactgtcatgggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgggactagaggagtgcaggtggagactatctccccaggagacgggcgcaccttccccaagcgcggccagacctgcgtggtgcactacaccgggatgcttgaagatggaaagaaagttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaa

SEQ ID NO: 7782 - DNA, 2577 bp, Artificial Sequence
  Synthetic Polynucleotide
atgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcagtctttgcacatcattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgggactagaggagtgcaggtggagactatctccccaggagacgggcgcaccttccccaagcgcggccagacctgcgtggtgcactacaccgggatgcttgaagatggaaagaaagttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaa

SEQ ID NO: 7783 - DNA, 1791 bp, Artificial Sequence
  Synthetic Polynucleotide
atggctagaccccatccttggtggctgtgtgtgctgggaacactcgtgggcctgtctgctacaccagctcctaagagctgccccgagagacactattgggctcagggcaagctgtgctgccagatgtgtgaacctggcaccttcctggtcaaggactgcgaccagcacagaaaggccgctcagtgcgatccttgtatccccggcgtgtccttctctcccgaccaccacacaagacctcactgcgagagctgccggcactgtaattctggactgctcgtgcggaactgcaccatcacagccaatgccgagtgcgcctgtagaaacggctggcagtgccgggacaaagaatgtaccgagtgcgaccctctgcctaatcctagcctgaccgccagaagcagccaggctttgtctcctcatcctcagcctacacatctgccctacgtgtccgagatgctggaagccagaacagccggccacatgcagaccctggctgactttagacagctgcccgccagaacactgagcacccattggcctccacagagaagcctgtgcagcagcgacacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagagccaagcgatctggatctggagcaacaaacttctcactactcaaacaagcaggtgacgtggaggagaatcccgggcctgggatccacatggctacctacgaggtgctgtgcgaggtggcaagaaagctgggcaccgacgacagagaagtggtgctgttcctgctgaacgtgttcatccctcagcctacactggcccagctgatcggtgcactgagagccctgaaagaggaaggccggctgacctttcctctgctggccgaatgcctgttcagagccggaagaagggatctgctgcgggacctgctgcatctggaccccagatttctggaaagacacctggccggcaccatgagctacttcagcccttaccagctgaccgtgctgcacgttgacggcgaactgtgcgccagagatattcggagcctgatcttcctgagcaaggacaccatcggcagccggtctacccctcagacatttctgcactgggtgtactgcatggaaaacctggacctgctcggccccacagatgtggatgccctgatgtccatgctgagaagcctgagcagagtggacctccagagacaggtgcagacactgatgggactgcacctgagcggacctagccacagccagcactacagacacaccccttga

SEQ ID NO: 7784 - DNA, 1635 bp, Artificial Sequence
  Synthetic Polynucleotide
atggctagaccccatccttggtggctgtgtgtgctgggaacactcgtgggcctgtctgctacaccagctcctaagagctgccccgagagacactattgggctcagggcaagctgtgctgccagatgtgtgaacctggcaccttcctggtcaaggactgcgaccagcacagaaaggccgctcagtgcgatccttgtatccccggcgtgtccttctctcccgaccaccacacaagacctcactgcgagagctgccggcactgtaattctggactgctcgtgcggaactgcaccatcacagccaatgccgagtgcgcctgtagaaacggctggcagtgccgggacaaagaatgtaccgagtgcgaccctctgcctaatcctagcctgaccgccagaagcagccaggctttgtctcctcatcctcagcctacacatctgccctacgtgtccgagatgctggaagccagaacagccggccacatgcagaccctggctgactttagacagctgcccgccagaacactgagcacccattggcctccacagagaagcctgtgcagcagcgacttcatcagaatcctcgtgatcttcagcggcatgttcctggtgttcaccctggcaggcgctctgtttcttacgcgtagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagagccaagcgatctggatctggagcaacaaacttctcactactcaaacaagcaggtgacgtggaggagaatcccgggcctgggatccacatggctacctacgaggtgctgtgcgaggtggcaagaaagctgggcaccgacgacagagaagtggtgctgttcctgctgaacgtgttcatccctcagcctacactggcccagctgatcggtgcactgagagccctgaaagaggaaggccggctgacctttcctctgctggccgaatgcctgttcagagccggaagaagggatctgctgcgggacctgctgcatctggaccccagatttctggaaagacacctggccggcaccatgagctacttcagcccttaccagctgaccgtgctgcacgttgacggcgaactgtgcgccagagatattcggagcctgatcttcctgagcaaggacaccatcggcagccggtctacccctcagacatttctgcactgggtgtactgcatggaaaacctggacctgctcggccccacagatgtggatgccctgatgtccatgctgagaagcctgagcagagtggacctccagagacaggtgcagacactgatgggactgcacctgagcggacctagccacagccagcactacagacacaccccttga

SEQ ID NO: 7785 - DNA, 2328 bp, Artificial Sequence
  Synthetic Polynucleotide
atggctagaccccatccttggtggctgtgtgtgctgggaacactcgtgggcctgtctgctacaccagctcctaagagctgccccgagagacactattgggctcagggcaagctgtgctgccagatgtgtgaacctggcaccttcctggtcaaggactgcgaccagcacagaaaggccgctcagtgcgatccttgtatccccggcgtgtccttctctcccgaccaccacacaagacctcactgcgagagctgccggcactgtaattctggactgctcgtgcggaactgcaccatcacagccaatgccgagtgcgcctgtagaaacggctggcagtgccgggacaaagaatgtaccgagtgcgaccctctgcctaatcctagcctgaccgccagaagcagccaggctttgtctcctcatcctcagcctacacatctgccctacgtgtccgagatgctggaagccagaacagccggccacatgcagaccctggctgactttagacagctgcccgccagaacactgagcacccattggcctccacagagaagcctgtgcagcagcgacttcatcagaatcctcgtgatcttcagcggcatgttcctggtgttcaccctggcaggcgctctgtttcttacgcgtagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagagccaagcgatctggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 7786 - DNA, 2478 bp, Artificial Sequence
  Synthetic Polynucleotide
atggctagaccccatccttggtggctgtgtgtgctgggaacactcgtgggcctgtctgctacaccagctcctaagagctgccccgagagacactattgggctcagggcaagctgtgctgccagatgtgtgaacctggcaccttcctggtcaaggactgcgaccagcacagaaaggccgctcagtgcgatccttgtatccccggcgtgtccttctctcccgaccaccacacaagacctcactgcgagagctgccggcactgtaattctggactgctcgtgcggaactgcaccatcacagccaatgccgagtgcgcctgtagaaacggctggcagtgccgggacaaagaatgtaccgagtgcgaccctctgcctaatcctagcctgaccgccagaagcagccaggctttgtctcctcatcctcagcctacacatctgccctacgtgtccgagatgctggaagccagaacagccggccacatgcagaccctggctgactttagacagctgcccgccagaacactgagcacccattggcctccacagagaagcctgtgcagcagcgacacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagagccaagcgatctggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 7787 - DNA, 2373 bp, Artificial Sequence
  Synthetic Polynucleotide
atggctagaccccatccttggtggctgtgtgtgctgggaacactcgtgggcctgtctgctacaccagctcctaagagctgccccgagagacactattgggctcagggcaagctgtgctgccagatgtgtgaacctggcaccttcctggtcaaggactgcgaccagcacagaaaggccgctcagtgcgatccttgtatccccggcgtgtccttctctcccgaccaccacacaagacctcactgcgagagctgccggcactgtaattctggactgctcgtgcggaactgcaccatcacagccaatgccgagtgcgcctgtagaaacggctggcagtgccgggacaaagaatgtaccgagtgcgaccctctgcctaatcctagcctgaccgccagaagcagccaggctttgtctcctcatcctcagcctacacatctgccctacgtgtccgagatgctggaagccagaacagccggccacatgcagaccctggctgactttagacagctgcccgccagaacactgagcacccattggcctccacagagaagcctgtgcagcagcgacacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagagccaagcgatctggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 7788 - DNA, 2403 bp, Artificial Sequence
  Synthetic Polynucleotide
atggctagaccccatccttggtggctgtgtgtgctgggaacactcgtgggcctgtctgctacaccagctcctaagagctgccccgagagacactattgggctcagggcaagctgtgctgccagatgtgtgaacctggcaccttcctggtcaaggactgcgaccagcacagaaaggccgctcagtgcgatccttgtatccccggcgtgtccttctctcccgaccaccacacaagacctcactgcgagagctgccggcactgtaattctggactgctcgtgcggaactgcaccatcacagccaatgccgagtgcgcctgtagaaacggctggcagtgccgggacaaagaatgtaccgagtgcgaccctctgcctaatcctagcctgaccgccagaagcagccaggctttgtctcctcatcctcagcctacacatctgccctacgtgtccgagatgctggaagccagaacagccggccacatgcagaccctggctgactttagacagctgcccgccagaacactgagcacccattggcctccacagagaagcctgtgcagcagcgacacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagagccaagcgatctggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 7789 - DNA, 2352 bp, Artificial Sequence
  Synthetic Polynucleotide
atggctagaccccatccttggtggctgtgtgtgctgggaacactcgtgggcctgtctgctacaccagctcctaagagctgccccgagagacactattgggctcagggcaagctgtgctgccagatgtgtgaacctggcaccttcctggtcaaggactgcgaccagcacagaaaggccgctcagtgcgatccttgtatccccggcgtgtccttctctcccgaccaccacacaagacctcactgcgagagctgccggcactgtaattctggactgctcgtgcggaactgcaccatcacagccaatgccgagtgcgcctgtagaaacggctggcagtgccgggacaaagaatgtaccgagtgcgaccctctgcctaatcctagcctgaccgccagaagcagccaggctttgtctcctcatcctcagcctacacatctgccctacgtgtccgagatgctggaagccagaacagccggccacatgcagaccctggctgactttagacagctgcccgccagaacactgagcacccattggcctccacagagaagcctgtgcagcagcgacacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagagccaagcgatctggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 7790 - DNA, 633 bp, Artificial Sequence
  Synthetic Polynucleotide
atggctagaccccatccttggtggctgtgtgtgctgggaacactcgtgggcctgtctgctacaccagctcctaagagctgccccgagagacactattgggctcagggcaagctgtgctgccagatgtgtgaacctggcaccttcctggtcaaggactgcgaccagcacagaaaggccgctcagtgcgatccttgtatccccggcgtgtccttctctcccgaccaccacacaagacctcactgcgagagctgccggcactgtaattctggactgctcgtgcggaactgcaccatcacagccaatgccgagtgcgcctgtagaaacggctggcagtgccgggacaaagaatgtaccgagtgcgaccctctgcctaatcctagcctgaccgccagaagcagccaggctttgtctcctcatcctcagcctacacatctgccctacgtgtccgagatgctggaagccagaacagccggccacatgcagaccctggctgactttagacagctgcccgccagaacactgagcacccattggcctccacagagaagcctgtgcagcagcgacttcatcagaatcctcgtgatcttcagcggcatgttcctggtgttcaccctggcaggcgctctgtttctt

SEQ ID NO: 7791 - DNA, 564 bp, Artificial Sequence
  Synthetic Polynucleotide
atggctagaccccatccttggtggctgtgtgtgctgggaacactcgtgggcctgtctgctacaccagctcctaagagctgccccgagagacactattgggctcagggcaagctgtgctgccagatgtgtgaacctggcaccttcctggtcaaggactgcgaccagcacagaaaggccgctcagtgcgatccttgtatccccggcgtgtccttctctcccgaccaccacacaagacctcactgcgagagctgccggcactgtaattctggactgctcgtgcggaactgcaccatcacagccaatgccgagtgcgcctgtagaaacggctggcagtgccgggacaaagaatgtaccgagtgcgaccctctgcctaatcctagcctgaccgccagaagcagccaggctttgtctcctcatcctcagcctacacatctgccctacgtgtccgagatgctggaagccagaacagccggccacatgcagaccctggctgactttagacagctgcccgccagaacactgagcacccattggcctccacagagaagcctgtgcagcagcgac

SEQ ID NO: 7792 - DNA, 333 bp, Artificial Sequence; identical to SEQ ID NO: 14
  Synthetic Polynucloetide encoding a light chain variable (vL) fragment

SEQ ID NO: 7793 - DNA, 321 bp, Artificial Sequence; identical to SEQ ID NO: 15
  Synthetic Polynucloetide encoding a vL fragment

SEQ ID NO: 7794 - DNA, 336 bp, Artificial Sequence; identical to SEQ ID NO: 16
  Synthetic Polynucloetide encoding a vL fragment

SEQ ID NO: 7795 - DNA, 336 bp, Artificial Sequence; identical to SEQ ID NO: 17
  Synthetic Polynucloetide encoding a vL fragment

SEQ ID NO: 7796 - DNA, 333 bp, Artificial Sequence; identical to SEQ ID NO: 18
  Synthetic Polynucloetide encoding a vL fragment

SEQ ID NO: 7797 - DNA, 336 bp, Artificial Sequence; identical to SEQ ID NO: 19
  Synthetic Polynucloetide encoding a vL fragment

SEQ ID NO: 7798 - DNA, 324 bp, Artificial Sequence; identical to SEQ ID NO: 20
  Synthetic Polynucloetide encoding a vL fragment

SEQ ID NO: 7799 - DNA, 336 bp, Artificial Sequence; identical to SEQ ID NO: 24
  Synthetic Polynucloetide encoding a vL fragment

SEQ ID NO: 7800 - DNA, 342 bp, Artificial Sequence; identical to SEQ ID NO: 25
  Synthetic Polynucloetide encoding a vL fragment

SEQ ID NO: 7801 - DNA, 321 bp, Artificial Sequence; identical to SEQ ID NO: 38
  Synthetic Polynucloetide encoding a vL fragment

SEQ ID NO: 7802 - DNA, 318 bp, Artificial Sequence; identical to SEQ ID NO: 39
  Synthetic Polynucloetide encoding a vL fragment

SEQ ID NO: 7803 - DNA, 339 bp, Artificial Sequence; identical to SEQ ID NO: 40
  Synthetic Polynucloetide encoding a vL fragment

SEQ ID NO: 7804 - DNA, 321 bp, Artificial Sequence; identical to SEQ ID NO: 41
  Synthetic Polynucloetide encoding a vL fragment

SEQ ID NO: 7805 - DNA, 333 bp, Artificial Sequence; identical to SEQ ID NO: 42
  Synthetic Polynucloetide encoding a vL fragment

SEQ ID NO: 7806 - DNA, 321 bp, Artificial Sequence; identical to SEQ ID NO: 43
  Synthetic Polynucloetide encoding a vL fragment

SEQ ID NO: 7807 - DNA, 321 bp, Artificial Sequence; identical to SEQ ID NO: 44
  Synthetic Polynucloetide encoding a vL fragment

SEQ ID NO: 7808 - DNA, 321 bp, Artificial Sequence; identical to SEQ ID NO: 45
  Synthetic Polynucloetide encoding a vL fragment

SEQ ID NO: 7809 - DNA, 321 bp, Artificial Sequence; identical to SEQ ID NO: 46
  Synthetic Polynucloetide encoding a vL fragment

SEQ ID NO: 7810 - DNA, 321 bp, Artificial Sequence; identical to SEQ ID NO: 56
  Synthetic Polynucloetide encoding a vL fragment

SEQ ID NO: 7811 - DNA, 339 bp, Artificial Sequence; identical to SEQ ID NO: 57
  Synthetic Polynucloetide encoding a vL fragment

SEQ ID NO: 7812 - DNA, 339 bp, Artificial Sequence; identical to SEQ ID NO: 69
  Synthetic Polynucloetide encoding a vL fragment

SEQ ID NO: 7813 - DNA, 324 bp, Artificial Sequence; identical to SEQ ID NO: 70
  Synthetic Polynucloetide encoding a vL fragment

SEQ ID NO: 7814 - DNA, 321 bp, Artificial Sequence; identical to SEQ ID NO: 71
  Synthetic Polynucloetide encoding a vL fragment

SEQ ID NO: 7815 - DNA, 330 bp, Artificial Sequence; identical to SEQ ID NO: 72
  Synthetic Polynucloetide encoding a vL fragment

SEQ ID NO: 7816 - DNA, 336 bp, Artificial Sequence; identical to SEQ ID NO: 73
  Synthetic Polynucloetide encoding a vL fragment

SEQ ID NO: 7817 - DNA, 336 bp, Artificial Sequence; identical to SEQ ID NO: 74
  Synthetic Polynucloetide encoding a vL fragment

SEQ ID NO: 7818 - DNA, 321 bp, Artificial Sequence; identical to SEQ ID NO: 75
  Synthetic Polynucloetide encoding a vL fragment

SEQ ID NO: 7819 - DNA, 336 bp, Artificial Sequence; identical to SEQ ID NO: 76
  Synthetic Polynucloetide encoding a vL fragment

SEQ ID NO: 7820 - DNA, 318 bp, Artificial Sequence; identical to SEQ ID NO: 77
  Synthetic Polynucloetide encoding a vL fragment

SEQ ID NO: 7821 - DNA, 339 bp, Artificial Sequence; identical to SEQ ID NO: 78
  Synthetic Polynucloetide encoding a vL fragment

SEQ ID NO: 7822 - DNA, 342 bp, Artificial Sequence; identical to SEQ ID NO: 79
  Synthetic Polynucloetide encoding a vL fragment

SEQ ID NO: 7823 - DNA, 342 bp, Artificial Sequence; identical to SEQ ID NO: 86
  Synthetic Polynucloetide encoding a vL fragment

SEQ ID NO: 7824 - DNA, 339 bp, Artificial Sequence; identical to SEQ ID NO: 87
  Synthetic Polynucloetide encoding a vL fragment

SEQ ID NO: 7825 - DNA, 318 bp, Artificial Sequence; identical to SEQ ID NO: 88
  Synthetic Polynucloetide encoding a vL fragment

SEQ ID NO: 7826 - DNA, 324 bp, Artificial Sequence; identical to SEQ ID NO: 89
  Synthetic Polynucloetide encoding a vL fragment

SEQ ID NO: 7827 - DNA, 327 bp, Artificial Sequence; identical to SEQ ID NO: 90
  Synthetic Polynucloetide encoding a vL fragment

SEQ ID NO: 7828 - DNA, 336 bp, Artificial Sequence; identical to SEQ ID NO: 91
  Synthetic Polynucloetide encoding a vL fragment

SEQ ID NO: 7829 - DNA, 339 bp, Artificial Sequence; identical to SEQ ID NO: 92
  Synthetic Polynucloetide encoding a vL fragment

SEQ ID NO: 7830 - DNA, 339 bp, Artificial Sequence; identical to SEQ ID NO: 93
  Synthetic Polynucloetide encoding a vL fragment

SEQ ID NO: 7831 - DNA, 342 bp, Artificial Sequence; identical to SEQ ID NO: 95
  Synthetic Polynucloetide encoding a vL fragment

SEQ ID NO: 7832 - DNA, 327 bp, Artificial Sequence; identical to SEQ ID NO: 96
  Synthetic Polynucloetide encoding a vL fragment

SEQ ID NO: 7833 - DNA, 324 bp, Artificial Sequence; identical to SEQ ID NO: 97
  Synthetic Polynucloetide encoding a vL fragment

SEQ ID NO: 7834 - DNA, 327 bp, Artificial Sequence; identical to SEQ ID NO: 98
  Synthetic Polynucloetide encoding a vL fragment

SEQ ID NO: 7835 - DNA, 318 bp, Artificial Sequence; identical to SEQ ID NO: 99
  Synthetic Polynucloetide encoding a vL fragment

SEQ ID NO: 7836 - DNA, 312 bp, Artificial Sequence; identical to SEQ ID NO: 100
  Synthetic Polynucloetide encoding a vL fragment

SEQ ID NO: 7837 - DNA, 321 bp, Artificial Sequence; identical to SEQ ID NO: 101
  Synthetic Polynucloetide encoding a vL fragment

SEQ ID NO: 7838 - DNA, 336 bp, Artificial Sequence; identical to SEQ ID NO: 102
  Synthetic Polynucloetide encoding a vL fragment

SEQ ID NO: 7839 - DNA, 360 bp, Artificial Sequence; identical to SEQ ID NO: 107
  Synthetic Polynucloetide encoding a vL fragment

SEQ ID NO: 7840 - DNA, 321 bp, Artificial Sequence; identical to SEQ ID NO: 108
  Synthetic Polynucloetide encoding a vL fragment

SEQ ID NO: 7841 - DNA, 324 bp, Artificial Sequence; identical to SEQ ID NO: 109
  Synthetic Polynucloetide encoding a vL fragment

SEQ ID NO: 7842 - DNA, 321 bp, Artificial Sequence; identical to SEQ ID NO: 110
  Synthetic Polynucloetide encoding a vL fragment

SEQ ID NO: 7843 - DNA, 321 bp, Artificial Sequence; identical to SEQ ID NO: 111
  Synthetic Polynucloetide encoding a vL fragment

SEQ ID NO: 7844 - DNA, 339 bp, Artificial Sequence; identical to SEQ ID NO: 118
  Synthetic Polynucloetide encoding a vL fragment

SEQ ID NO: 7845 - DNA, 339 bp, Artificial Sequence; identical to SEQ ID NO: 119
  Synthetic Polynucloetide encoding a vL fragment

SEQ ID NO: 7846 - DNA, 321 bp, Artificial Sequence; identical to SEQ ID NO: 120
  Synthetic Polynucloetide encoding a vL fragment

SEQ ID NO: 7847 - DNA, 324 bp, Artificial Sequence; identical to SEQ ID NO: 121
  Synthetic Polynucloetide encoding a vL fragment

SEQ ID NO: 7848 - DNA, 333 bp, Artificial Sequence; identical to SEQ ID NO: 122
  Synthetic Polynucloetide encoding a vL fragment

SEQ ID NO: 7849 - DNA, 321 bp, Artificial Sequence; identical to SEQ ID NO: 123
  Synthetic Polynucloetide encoding a vL fragment

SEQ ID NO: 7850 - DNA, 333 bp, Artificial Sequence; identical to SEQ ID NO: 124
  Synthetic Polynucloetide encoding a vL fragment

SEQ ID NO: 7851 - DNA, 315 bp, Artificial Sequence; identical to SEQ ID NO: 125
  Synthetic Polynucloetide encoding a vL fragment

SEQ ID NO: 7852 - DNA, 336 bp, Artificial Sequence; identical to SEQ ID NO: 126
  Synthetic Polynucloetide encoding a vL fragment

SEQ ID NO: 7853 - DNA, 321 bp, Artificial Sequence; identical to SEQ ID NO: 127
  Synthetic Polynucloetide encoding a vL fragment

SEQ ID NO: 7854 - DNA, 339 bp, Artificial Sequence; identical to SEQ ID NO: 128
  Synthetic Polynucloetide encoding a vL fragment

SEQ ID NO: 7855 - DNA, 336 bp, Artificial Sequence; identical to SEQ ID NO: 129
  Synthetic Polynucloetide encoding a vL fragment

SEQ ID NO: 7856 - DNA, 321 bp, Artificial Sequence; identical to SEQ ID NO: 132
  Synthetic Polynucloetide encoding a vL fragment

SEQ ID NO: 7857 - DNA, 309 bp, Artificial Sequence; identical to SEQ ID NO: 133
  Synthetic Polynucloetide encoding a vL fragment

SEQ ID NO: 7858 - DNA, 336 bp, Artificial Sequence; identical to SEQ ID NO: 134
  Synthetic Polynucloetide encoding a vL fragment

SEQ ID NO: 7859 - DNA, 327 bp, Artificial Sequence; identical to SEQ ID NO: 135
  Synthetic Polynucloetide encoding a vL fragment

SEQ ID NO: 7860 - DNA, 339 bp, Artificial Sequence; identical to SEQ ID NO: 136
  Synthetic Polynucloetide encoding a vL fragment

SEQ ID NO: 7861 - DNA, 315 bp, Artificial Sequence; identical to SEQ ID NO: 137
  Synthetic Polynucloetide encoding a vL fragment

SEQ ID NO: 7862 - DNA, 324 bp, Artificial Sequence; identical to SEQ ID NO: 138
  Synthetic Polynucloetide encoding a vL fragment

SEQ ID NO: 7863 - DNA, 333 bp, Artificial Sequence; identical to SEQ ID NO: 139
  Synthetic Polynucloetide encoding a vL fragment

SEQ ID NO: 7864 - DNA, 333 bp, Artificial Sequence; identical to SEQ ID NO: 140
  Synthetic Polynucloetide encoding a vL fragment

SEQ ID NO: 7865 - DNA, 333 bp, Artificial Sequence; identical to SEQ ID NO: 141
  Synthetic Polynucloetide encoding a vL fragment

SEQ ID NO: 7866 - DNA, 321 bp, Artificial Sequence; identical to SEQ ID NO: 142
  Synthetic Polynucloetide encoding a vL fragment

SEQ ID NO: 7867 - DNA, 321 bp, Artificial Sequence; identical to SEQ ID NO: 75
  Synthetic Polynucloetide encoding a vL fragment

SEQ ID NO: 7868 - DNA, 336 bp, Artificial Sequence; identical to SEQ ID NO: 144
  Synthetic Polynucloetide encoding a vL fragment

SEQ ID NO: 7869 - DNA, 321 bp, Artificial Sequence; identical to SEQ ID NO: 145
  Synthetic Polynucloetide encoding a vL fragment

SEQ ID NO: 7870 - DNA, 336 bp, Artificial Sequence; identical to SEQ ID NO: 146
  Synthetic Polynucloetide encoding a vL fragment

SEQ ID NO: 7871 - DNA, 321 bp, Artificial Sequence; identical to SEQ ID NO: 147
  Synthetic Polynucloetide encoding a vL fragment

SEQ ID NO: 7872 - DNA, 333 bp, Artificial Sequence; identical to SEQ ID NO: 148
  Synthetic Polynucloetide encoding a vL fragment

SEQ ID NO: 7873 - DNA, 333 bp, Artificial Sequence; identical to SEQ ID NO: 149
  Synthetic Polynucloetide encoding a vL fragment

SEQ ID NO: 7874 - DNA, 321 bp, Artificial Sequence; identical to SEQ ID NO: 152
  Synthetic Polynucloetide encoding a vL fragment

SEQ ID NO: 7875 - DNA, 315 bp, Artificial Sequence; identical to SEQ ID NO: 153
  Synthetic Polynucloetide encoding a vL fragment

SEQ ID NO: 7876 - DNA, 321 bp, Artificial Sequence; identical to SEQ ID NO: 154
  Synthetic Polynucloetide encoding a vL fragment

SEQ ID NO: 7877 - DNA, 315 bp, Artificial Sequence; identical to SEQ ID NO: 155
  Synthetic Polynucloetide encoding a vL fragment

SEQ ID NO: 7878 - DNA, 312 bp, Artificial Sequence; identical to SEQ ID NO: 156
  Synthetic Polynucloetide encoding a vL fragment

SEQ ID NO: 7879 - DNA, 321 bp, Artificial Sequence; identical to SEQ ID NO: 157
  Synthetic Polynucloetide encoding a vL fragment

SEQ ID NO: 7880 - DNA, 324 bp, Artificial Sequence; identical to SEQ ID NO: 159
  Synthetic Polynucloetide encoding a vL fragment

SEQ ID NO: 7881 - DNA, 327 bp, Artificial Sequence; identical to SEQ ID NO: 162
  Synthetic Polynucloetide encoding a vL fragment

SEQ ID NO: 7882 - DNA, 339 bp, Artificial Sequence; identical to SEQ ID NO: 163
  Synthetic Polynucloetide encoding a vL fragment

SEQ ID NO: 7883 - DNA, 291 bp, Artificial Sequence; identical to SEQ ID NO: 164
  Synthetic Polynucloetide encoding a vL fragment

SEQ ID NO: 7884 - DNA, 327 bp, Artificial Sequence; identical to SEQ ID NO: 165
  Synthetic Polynucloetide encoding a vL fragment

SEQ ID NO: 7885 - DNA, 321 bp, Artificial Sequence; identical to SEQ ID NO: 166
  Synthetic Polynucloetide encoding a vL fragment

SEQ ID NO: 7886 - DNA, 321 bp, Artificial Sequence; identical to SEQ ID NO: 448
  Synthetic Polynucloetide encoding a vL fragment

SEQ ID NO: 7887 - DNA, 309 bp, Artificial Sequence; identical to SEQ ID NO: 168
  Synthetic Polynucloetide encoding a vL fragment

SEQ ID NO: 7888 - DNA, 318 bp, Artificial Sequence; identical to SEQ ID NO: 169
  Synthetic Polynucloetide encoding a vL fragment

SEQ ID NO: 7889 - DNA, 339 bp, Artificial Sequence; identical to SEQ ID NO: 170
  Synthetic Polynucloetide encoding a vL fragment

SEQ ID NO: 7890 - DNA, 324 bp, Artificial Sequence; identical to SEQ ID NO: 171
  Synthetic Polynucloetide encoding a vL fragment

SEQ ID NO: 7891 - DNA, 321 bp, Artificial Sequence; identical to SEQ ID NO: 172
  Synthetic Polynucloetide encoding a vL fragment

SEQ ID NO: 7892 - DNA, 321 bp, Artificial Sequence; identical to SEQ ID NO: 173
  Synthetic Polynucloetide encoding a vL fragment

SEQ ID NO: 7893 - DNA, 336 bp, Artificial Sequence; identical to SEQ ID NO: 174
  Synthetic Polynucloetide encoding a vL fragment

SEQ ID NO: 7894 - DNA, 321 bp, Artificial Sequence; identical to SEQ ID NO: 175
  Synthetic Polynucloetide encoding a vL fragment

SEQ ID NO: 7895 - DNA, 321 bp, Artificial Sequence; identical to SEQ ID NO: 176
  Synthetic Polynucloetide encoding a vL fragment

SEQ ID NO: 7896 - DNA, 348 bp, Artificial Sequence; identical to SEQ ID NO: 177
  Synthetic Polynucloetide encoding a vL fragment

SEQ ID NO: 7897 - DNA, 345 bp, Artificial Sequence; identical to SEQ ID NO: 178
  Synthetic Polynucloetide encoding a vL fragment

SEQ ID NO: 7898 - DNA, 324 bp, Artificial Sequence; identical to SEQ ID NO: 179
  Synthetic Polynucloetide encoding a vL fragment

SEQ ID NO: 7899 - DNA, 324 bp, Artificial Sequence; identical to SEQ ID NO: 180
  Synthetic Polynucloetide encoding a vL fragment

SEQ ID NO: 7900 - DNA, 321 bp, Artificial Sequence; identical to SEQ ID NO: 181
  Synthetic Polynucloetide encoding a vL fragment

SEQ ID NO: 7901 - DNA, 321 bp, Artificial Sequence; identical to SEQ ID NO: 182
  Synthetic Polynucloetide encoding a vL fragment

SEQ ID NO: 7902 - DNA, 318 bp, Artificial Sequence; identical to SEQ ID NO: 183
  Synthetic Polynucloetide encoding a vL fragment

SEQ ID NO: 7903 - DNA, 336 bp, Artificial Sequence; identical to SEQ ID NO: 184
  Synthetic Polynucloetide encoding a vL fragment

SEQ ID NO: 7904 - DNA, 336 bp, Artificial Sequence; identical to SEQ ID NO: 185
  Synthetic Polynucloetide encoding a vL fragment

SEQ ID NO: 7905 - DNA, 345 bp, Artificial Sequence; identical to SEQ ID NO: 186
  Synthetic Polynucloetide encoding a vL fragment

SEQ ID NO: 7906 - DNA, 333 bp, Artificial Sequence; identical to SEQ ID NO: 187
  Synthetic Polynucloetide encoding a vL fragment

SEQ ID NO: 7907 - DNA, 327 bp, Artificial Sequence; identical to SEQ ID NO: 188
  Synthetic Polynucloetide encoding a vL fragment

SEQ ID NO: 7908 - DNA, 324 bp, Artificial Sequence; identical to SEQ ID NO: 189
  Synthetic Polynucloetide encoding a vL fragment

SEQ ID NO: 7909 - DNA, 339 bp, Artificial Sequence; identical to SEQ ID NO: 190
  Synthetic Polynucloetide encoding a vL fragment

SEQ ID NO: 7910 - DNA, 327 bp, Artificial Sequence; identical to SEQ ID NO: 191
  Synthetic Polynucloetide encoding a vL fragment

SEQ ID NO: 7911 - DNA, 336 bp, Artificial Sequence; identical to SEQ ID NO: 192
  Synthetic Polynucloetide encoding a vL fragment

SEQ ID NO: 7912 - DNA, 330 bp, Artificial Sequence; identical to SEQ ID NO: 193
  Synthetic Polynucloetide encoding a vL fragment

SEQ ID NO: 7913 - DNA, 291 bp, Artificial Sequence; identical to SEQ ID NO: 194
  Synthetic Polynucloetide encoding a vL fragment

SEQ ID NO: 7914 - DNA, 321 bp, Artificial Sequence; identical to SEQ ID NO: 195
  Synthetic Polynucloetide encoding a vL fragment

SEQ ID NO: 7915 - DNA, 321 bp, Artificial Sequence; identical to SEQ ID NO: 196
  Synthetic Polynucloetide encoding a vL fragment

SEQ ID NO: 7916 - DNA, 324 bp, Artificial Sequence; identical to SEQ ID NO: 197
  Synthetic Polynucloetide encoding a vL fragment

SEQ ID NO: 7917 - DNA, 336 bp, Artificial Sequence; identical to SEQ ID NO: 198
  Synthetic Polynucloetide encoding a vL fragment

SEQ ID NO: 7918 - DNA, 324 bp, Artificial Sequence; identical to SEQ ID NO: 199
  Synthetic Polynucloetide encoding a vL fragment

SEQ ID NO: 7919 - DNA, 318 bp, Artificial Sequence; identical to SEQ ID NO: 200
  Synthetic Polynucloetide encoding a vL fragment

SEQ ID NO: 7920 - DNA, 339 bp, Artificial Sequence; identical to SEQ ID NO: 201
  Synthetic Polynucloetide encoding a vL fragment

SEQ ID NO: 7921 - DNA, 321 bp, Artificial Sequence; identical to SEQ ID NO: 202
  Synthetic Polynucloetide encoding a vL fragment

SEQ ID NO: 7922 - DNA, 321 bp, Artificial Sequence; identical to SEQ ID NO: 203
  Synthetic Polynucloetide encoding a vL fragment

SEQ ID NO: 7923 - DNA, 309 bp, Artificial Sequence; identical to SEQ ID NO: 204
  Synthetic Polynucloetide encoding a vL fragment

SEQ ID NO: 7924 - DNA, 324 bp, Artificial Sequence; identical to SEQ ID NO: 205
  Synthetic Polynucloetide encoding a vL fragment

SEQ ID NO: 7925 - DNA, 321 bp, Artificial Sequence; identical to SEQ ID NO: 206
  Synthetic Polynucloetide encoding a vL fragment

SEQ ID NO: 7926 - DNA, 324 bp, Artificial Sequence; identical to SEQ ID NO: 207
  Synthetic Polynucloetide encoding a vL fragment

SEQ ID NO: 7927 - DNA, 321 bp, Artificial Sequence; identical to SEQ ID NO: 208
  Synthetic Polynucloetide encoding a vL fragment

SEQ ID NO: 7928 - DNA, 324 bp, Artificial Sequence; identical to SEQ ID NO: 209
  Synthetic Polynucloetide encoding a vL fragment

SEQ ID NO: 7929 - DNA, 318 bp, Artificial Sequence; identical to SEQ ID NO: 210
  Synthetic Polynucloetide encoding a vL fragment

SEQ ID NO: 7930 - DNA, 324 bp, Artificial Sequence; identical to SEQ ID NO: 211
  Synthetic Polynucloetide encoding a vL fragment

SEQ ID NO: 7931 - DNA, 339 bp, Artificial Sequence; identical to SEQ ID NO: 212
  Synthetic Polynucloetide encoding a vL fragment

SEQ ID NO: 7932 - DNA, 327 bp, Artificial Sequence; identical to SEQ ID NO: 213
  Synthetic Polynucloetide encoding a vL fragment

SEQ ID NO: 7933 - DNA, 339 bp, Artificial Sequence; identical to SEQ ID NO: 214
  Synthetic Polynucloetide encoding a vL fragment

SEQ ID NO: 7934 - DNA, 324 bp, Artificial Sequence; identical to SEQ ID NO: 215
  Synthetic Polynucloetide encoding a vL fragment

SEQ ID NO: 7935 - DNA, 327 bp, Artificial Sequence; identical to SEQ ID NO: 216
  Synthetic Polynucloetide encoding a vL fragment

SEQ ID NO: 7936 - DNA, 324 bp, Artificial Sequence; identical to SEQ ID NO: 217
  Synthetic Polynucloetide encoding a vL fragment

SEQ ID NO: 7937 - DNA, 321 bp, Artificial Sequence; identical to SEQ ID NO: 219
  Synthetic Polynucloetide encoding a vL fragment

SEQ ID NO: 7938 - DNA, 342 bp, Artificial Sequence; identical to SEQ ID NO: 220
  Synthetic Polynucloetide encoding a vL fragment

SEQ ID NO: 7939 - DNA, 321 bp, Artificial Sequence; identical to SEQ ID NO: 221
  Synthetic Polynucloetide encoding a vL fragment

SEQ ID NO: 7940 - DNA, 324 bp, Artificial Sequence; identical to SEQ ID NO: 222
  Synthetic Polynucloetide encoding a vL fragment

SEQ ID NO: 7941 - DNA, 339 bp, Artificial Sequence; identical to SEQ ID NO: 223
  Synthetic Polynucloetide encoding a vL fragment

SEQ ID NO: 7942 - DNA, 321 bp, Artificial Sequence; identical to SEQ ID NO: 224
  Synthetic Polynucloetide encoding a vL fragment

SEQ ID NO: 7943 - DNA, 333 bp, Artificial Sequence; identical to SEQ ID NO: 225
  Synthetic Polynucloetide encoding a vL fragment

SEQ ID NO: 7944 - DNA, 327 bp, Artificial Sequence; identical to SEQ ID NO: 226
  Synthetic Polynucloetide encoding a vL fragment

SEQ ID NO: 7945 - DNA, 321 bp, Artificial Sequence; identical to SEQ ID NO: 227
  Synthetic Polynucloetide encoding a vL fragment

SEQ ID NO: 7946 - DNA, 321 bp, Artificial Sequence; identical to SEQ ID NO: 228
  Synthetic Polynucloetide encoding a vL fragment

SEQ ID NO: 7947 - DNA, 324 bp, Artificial Sequence; identical to SEQ ID NO: 229
  Synthetic Polynucloetide encoding a vL fragment

SEQ ID NO: 7948 - DNA, 339 bp, Artificial Sequence; identical to SEQ ID NO: 230
  Synthetic Polynucloetide encoding a vL fragment

SEQ ID NO: 7949 - DNA, 339 bp, Artificial Sequence; identical to SEQ ID NO: 231
  Synthetic Polynucloetide encoding a vL fragment

SEQ ID NO: 7950 - DNA, 339 bp, Artificial Sequence; identical to SEQ ID NO: 232
  Synthetic Polynucloetide encoding a vL fragment

SEQ ID NO: 7951 - DNA, 321 bp, Artificial Sequence; identical to SEQ ID NO: 233
  Synthetic Polynucloetide encoding a vL fragment

SEQ ID NO: 7952 - DNA, 330 bp, Artificial Sequence; identical to SEQ ID NO: 234
  Synthetic Polynucloetide encoding a vL fragment

SEQ ID NO: 7953 - DNA, 321 bp, Artificial Sequence; identical to SEQ ID NO: 235
  Synthetic Polynucloetide encoding a vL fragment

SEQ ID NO: 7954 - DNA, 333 bp, Artificial Sequence; identical to SEQ ID NO: 236
  Synthetic Polynucloetide encoding a vL fragment

SEQ ID NO: 7955 - DNA, 327 bp, Artificial Sequence; identical to SEQ ID NO: 237
  Synthetic Polynucloetide encoding a vL fragment

SEQ ID NO: 7956 - DNA, 327 bp, Artificial Sequence; identical to SEQ ID NO: 238
  Synthetic Polynucloetide encoding a vL fragment

SEQ ID NO: 7957 - DNA, 333 bp, Artificial Sequence; identical to SEQ ID NO: 26
  Synthetic Polynucloetide encoding a vL fragment

SEQ ID NO: 7958 - DNA, 324 bp, Artificial Sequence; identical to SEQ ID NO: 239
  Synthetic Polynucloetide encoding a vL fragment

SEQ ID NO: 7959 - DNA, 324 bp, Artificial Sequence; identical to SEQ ID NO: 240
  Synthetic Polynucloetide encoding a vL fragment

SEQ ID NO: 7960 - DNA, 321 bp, Artificial Sequence; identical to SEQ ID NO: 241
  Synthetic Polynucloetide encoding a vL fragment

SEQ ID NO: 7961 - DNA, 318 bp, Artificial Sequence; identical to SEQ ID NO: 242
  Synthetic Polynucloetide encoding a vL fragment

SEQ ID NO: 7962 - DNA, 318 bp, Artificial Sequence; identical to SEQ ID NO: 243
  Synthetic Polynucloetide encoding a vL fragment

SEQ ID NO: 7963 - DNA, 324 bp, Artificial Sequence; identical to SEQ ID NO: 244
  Synthetic Polynucloetide encoding a vL fragment

SEQ ID NO: 7964 - DNA, 336 bp, Artificial Sequence; identical to SEQ ID NO: 245
  Synthetic Polynucloetide encoding a vL fragment

SEQ ID NO: 7965 - DNA, 321 bp, Artificial Sequence; identical to SEQ ID NO: 246
  Synthetic Polynucloetide encoding a vL fragment

SEQ ID NO: 7966 - DNA, 321 bp, Artificial Sequence; identical to SEQ ID NO: 247
  Synthetic Polynucloetide encoding a vL fragment

SEQ ID NO: 7967 - DNA, 321 bp, Artificial Sequence; identical to SEQ ID NO: 248
  Synthetic Polynucloetide encoding a vL fragment

SEQ ID NO: 7968 - DNA, 324 bp, Artificial Sequence; identical to SEQ ID NO: 249
  Synthetic Polynucloetide encoding a vL fragment

SEQ ID NO: 7969 - DNA, 333 bp, Artificial Sequence; identical to SEQ ID NO: 11
  Synthetic Polynucloetide encoding a vL fragment

SEQ ID NO: 7970 - DNA, 330 bp, Artificial Sequence; identical to SEQ ID NO: 12
  Synthetic Polynucloetide encoding a vL fragment

SEQ ID NO: 7971 - DNA, 339 bp, Artificial Sequence; identical to SEQ ID NO: 13
  Synthetic Polynucloetide encoding a vL fragment

SEQ ID NO: 7972 - DNA, 342 bp, Artificial Sequence; identical to SEQ ID NO: 21
  Synthetic Polynucloetide encoding a vL fragment

SEQ ID NO: 7973 - DNA, 333 bp, Artificial Sequence; identical to SEQ ID NO: 22
  Synthetic Polynucloetide encoding a vL fragment

SEQ ID NO: 7974 - DNA, 336 bp, Artificial Sequence; identical to SEQ ID NO: 23
  Synthetic Polynucloetide encoding a vL fragment

SEQ ID NO: 7975 - DNA, 339 bp, Artificial Sequence; identical to SEQ ID NO: 27
  Synthetic Polynucloetide encoding a vL fragment

SEQ ID NO: 7976 - DNA, 339 bp, Artificial Sequence; identical to SEQ ID NO: 27
  Synthetic Polynucloetide encoding a vL fragment

SEQ ID NO: 7977 - DNA, 327 bp, Artificial Sequence; identical to SEQ ID NO: 29
  Synthetic Polynucloetide encoding a vL fragment

SEQ ID NO: 7978 - DNA, 333 bp, Artificial Sequence; identical to SEQ ID NO: 30
  Synthetic Polynucloetide encoding a vL fragment

SEQ ID NO: 7979 - DNA, 321 bp, Artificial Sequence; identical to SEQ ID NO: 31
  Synthetic Polynucloetide encoding a vL fragment

SEQ ID NO: 7980 - DNA, 324 bp, Artificial Sequence; identical to SEQ ID NO: 32
  Synthetic Polynucloetide encoding a vL fragment

SEQ ID NO: 7981 - DNA, 324 bp, Artificial Sequence; identical to SEQ ID NO: 33
  Synthetic Polynucloetide encoding a vL fragment

SEQ ID NO: 7982 - DNA, 321 bp, Artificial Sequence; identical to SEQ ID NO: 34
  Synthetic Polynucloetide encoding a vL fragment

SEQ ID NO: 7983 - DNA, 318 bp, Artificial Sequence; identical to SEQ ID NO: 35
  Synthetic Polynucloetide encoding a vL fragment

SEQ ID NO: 7984 - DNA, 339 bp, Artificial Sequence; identical to SEQ ID NO: 36
  Synthetic Polynucloetide encoding a vL fragment

SEQ ID NO: 7985 - DNA, 339 bp, Artificial Sequence; identical to SEQ ID NO: 37
  Synthetic Polynucloetide encoding a vL fragment

SEQ ID NO: 7986 - DNA, 333 bp, Artificial Sequence; identical to SEQ ID NO: 47
  Synthetic Polynucloetide encoding a vL fragment

SEQ ID NO: 7987 - DNA, 321 bp, Artificial Sequence; identical to SEQ ID NO: 48
  Synthetic Polynucloetide encoding a vL fragment

SEQ ID NO: 7988 - DNA, 336 bp, Artificial Sequence; identical to SEQ ID NO: 49
  Synthetic Polynucloetide encoding a vL fragment

SEQ ID NO: 7989 - DNA, 333 bp, Artificial Sequence; identical to SEQ ID NO: 50
  Synthetic Polynucloetide encoding a vL fragment

SEQ ID NO: 7990 - DNA, 333 bp, Artificial Sequence; identical to SEQ ID NO: 51
  Synthetic Polynucloetide encoding a vL fragment

SEQ ID NO: 7991 - DNA, 327 bp, Artificial Sequence; identical to SEQ ID NO: 52
  Synthetic Polynucloetide encoding a vL fragment

SEQ ID NO: 7992 - DNA, 312 bp, Artificial Sequence; identical to SEQ ID NO: 53
  Synthetic Polynucloetide encoding a vL fragment

SEQ ID NO: 7993 - DNA, 324 bp, Artificial Sequence; identical to SEQ ID NO: 54
  Synthetic Polynucloetide encoding a vL fragment

SEQ ID NO: 7994 - DNA, 336 bp, Artificial Sequence; identical to SEQ ID NO: 55
  Synthetic Polynucloetide encoding a vL fragment

SEQ ID NO: 7995 - DNA, 321 bp, Artificial Sequence; identical to SEQ ID NO: 58
  Synthetic Polynucloetide encoding a vL fragment

SEQ ID NO: 7996 - DNA, 321 bp, Artificial Sequence; identical to SEQ ID NO: 59
  Synthetic Polynucloetide encoding a vL fragment

SEQ ID NO: 7997 - DNA, 321 bp, Artificial Sequence; identical to SEQ ID NO: 60
  Synthetic Polynucloetide encoding a vL fragment

SEQ ID NO: 7998 - DNA, 321 bp, Artificial Sequence; identical to SEQ ID NO: 61
  Synthetic Polynucloetide encoding a vL fragment

SEQ ID NO: 7999 - DNA, 318 bp, Artificial Sequence; identical to SEQ ID NO: 62
  Synthetic Polynucloetide encoding a vL fragment

SEQ ID NO: 8000 - DNA, 333 bp, Artificial Sequence; identical to SEQ ID NO: 63
  Synthetic Polynucloetide encoding a vL fragment

SEQ ID NO: 8001 - DNA, 333 bp, Artificial Sequence; identical to SEQ ID NO: 64
  Synthetic Polynucloetide encoding a vL fragment

SEQ ID NO: 8002 - DNA, 318 bp, Artificial Sequence; identical to SEQ ID NO: 66
  Synthetic Polynucloetide encoding a vL fragment

SEQ ID NO: 8003 - DNA, 321 bp, Artificial Sequence; identical to SEQ ID NO: 56
  Synthetic Polynucloetide encoding a vL fragment

SEQ ID NO: 8004 - DNA, 321 bp, Artificial Sequence; identical to SEQ ID NO: 68
  Synthetic Polynucloetide encoding a vL fragment

SEQ ID NO: 8005 - DNA, 333 bp, Artificial Sequence; identical to SEQ ID NO: 80
  Synthetic Polynucloetide encoding a vL fragment

SEQ ID NO: 8006 - DNA, 321 bp, Artificial Sequence; identical to SEQ ID NO: 81
  Synthetic Polynucloetide encoding a vL fragment

SEQ ID NO: 8007 - DNA, 321 bp, Artificial Sequence; identical to SEQ ID NO: 82
  Synthetic Polynucloetide encoding a vL fragment

SEQ ID NO: 8008 - DNA, 336 bp, Artificial Sequence; identical to SEQ ID NO: 83
  Synthetic Polynucloetide encoding a vL fragment

SEQ ID NO: 8009 - DNA, 333 bp, Artificial Sequence; identical to SEQ ID NO: 84
  Synthetic Polynucloetide encoding a vL fragment

SEQ ID NO: 8010 - DNA, 321 bp, Artificial Sequence; identical to SEQ ID NO: 85
  Synthetic Polynucloetide encoding a vL fragment

SEQ ID NO: 8011 - DNA, 336 bp, Artificial Sequence; identical to SEQ ID NO: 94
  Synthetic Polynucloetide encoding a vL fragment

SEQ ID NO: 8012 - DNA, 318 bp, Artificial Sequence; identical to SEQ ID NO: 103
  Synthetic Polynucloetide encoding a vL fragment

SEQ ID NO: 8013 - DNA, 333 bp, Artificial Sequence; identical to SEQ ID NO: 104
  Synthetic Polynucloetide encoding a vL fragment

SEQ ID NO: 8014 - DNA, 324 bp, Artificial Sequence; identical to SEQ ID NO: 105
  Synthetic Polynucloetide encoding a vL fragment

SEQ ID NO: 8015 - DNA, 324 bp, Artificial Sequence; identical to SEQ ID NO: 106
  Synthetic Polynucloetide encoding a vL fragment

SEQ ID NO: 8016 - DNA, 327 bp, Artificial Sequence; identical to SEQ ID NO: 112
  Synthetic Polynucloetide encoding a vL fragment

SEQ ID NO: 8017 - DNA, 339 bp, Artificial Sequence; identical to SEQ ID NO: 113
  Synthetic Polynucloetide encoding a vL fragment

SEQ ID NO: 8018 - DNA, 339 bp, Artificial Sequence; identical to SEQ ID NO: 114
  Synthetic Polynucloetide encoding a vL fragment

SEQ ID NO: 8019 - DNA, 339 bp, Artificial Sequence; identical to SEQ ID NO: 115
  Synthetic Polynucloetide encoding a vL fragment

SEQ ID NO: 8020 - DNA, 321 bp, Artificial Sequence; identical to SEQ ID NO: 116
  Synthetic Polynucloetide encoding a vL fragment

SEQ ID NO: 8021 - DNA, 324 bp, Artificial Sequence; identical to SEQ ID NO: 117
  Synthetic Polynucloetide encoding a vL fragment

SEQ ID NO: 8022 - DNA, 336 bp, Artificial Sequence; identical to SEQ ID NO: 130
  Synthetic Polynucloetide encoding a vL fragment

SEQ ID NO: 8023 - DNA, 330 bp, Artificial Sequence; identical to SEQ ID NO: 131
  Synthetic Polynucloetide encoding a vL fragment

SEQ ID NO: 8024 - DNA, 339 bp, Artificial Sequence; identical to SEQ ID NO: 150
  Synthetic Polynucloetide encoding a vL fragment

SEQ ID NO: 8025 - DNA, 333 bp, Artificial Sequence; identical to SEQ ID NO: 151
  Synthetic Polynucloetide encoding a vL fragment

SEQ ID NO: 8026 - DNA, 324 bp, Artificial Sequence; identical to SEQ ID NO: 158
  Synthetic Polynucloetide encoding a vL fragment

SEQ ID NO: 8027 - DNA, 339 bp, Artificial Sequence; identical to SEQ ID NO: 160
  Synthetic Polynucloetide encoding a vL fragment

SEQ ID NO: 8028 - DNA, 330 bp, Artificial Sequence; identical to SEQ ID NO: 161
  Synthetic Polynucloetide encoding a vL fragment

SEQ ID NO: 8029 - DNA, 321 bp, Artificial Sequence; identical to SEQ ID NO: 196
  Synthetic Polynucloetide encoding a vL fragment

SEQ ID NO: 8030 - DNA, 339 bp, Artificial Sequence; identical to SEQ ID NO: 250
  Synthetic Polynucloetide encoding a vL fragment

SEQ ID NO: 8031 - DNA, 372 bp, Artificial Sequence; identical to SEQ ID NO: 251
  Synthetic Polynucloetide encoding a vL fragment

SEQ ID NO: 8032 - DNA, 324 bp, Artificial Sequence; identical to SEQ ID NO: 252
  Synthetic Polynucloetide encoding a vL fragment

SEQ ID NO: 8033 - DNA, 321 bp, Artificial Sequence; identical to SEQ ID NO: 196
  Synthetic Polynucloetide encoding a vL fragment

SEQ ID NO: 8034 - DNA, 324 bp, Artificial Sequence; identical to SEQ ID NO: 254
  Synthetic Polynucloetide encoding a vL fragment

SEQ ID NO: 8035 - DNA, 333 bp, Artificial Sequence; identical to SEQ ID NO: 255
  Synthetic Polynucloetide encoding a vL fragment

SEQ ID NO: 8036 - DNA, 336 bp, Artificial Sequence; identical to SEQ ID NO: 256
  Synthetic Polynucloetide encoding a vL fragment

SEQ ID NO: 8037 - DNA, 318 bp, Artificial Sequence; identical to SEQ ID NO: 257
  Synthetic Polynucloetide encoding a vL fragment

SEQ ID NO: 8038 - DNA, 339 bp, Artificial Sequence; identical to SEQ ID NO: 258
  Synthetic Polynucloetide encoding a vL fragment

SEQ ID NO: 8039 - DNA, 321 bp, Artificial Sequence; identical to SEQ ID NO: 259
  Synthetic Polynucloetide encoding a vL fragment

SEQ ID NO: 8040 - DNA, 339 bp, Artificial Sequence; identical to SEQ ID NO: 260
  Synthetic Polynucloetide encoding a vL fragment

SEQ ID NO: 8041 - DNA, 333 bp, Artificial Sequence; identical to SEQ ID NO: 261
  Synthetic Polynucloetide encoding a vL fragment

SEQ ID NO: 8042 - DNA, 336 bp, Artificial Sequence; identical to SEQ ID NO: 262
  Synthetic Polynucloetide encoding a vL fragment

SEQ ID NO: 8043 - DNA, 333 bp, Artificial Sequence; identical to SEQ ID NO: 263
  Synthetic Polynucloetide encoding a vL fragment

SEQ ID NO: 8044 - DNA, 336 bp, Artificial Sequence; identical to SEQ ID NO: 23
  Synthetic Polynucloetide encoding a vL fragment

SEQ ID NO: 8045 - DNA, 336 bp, Artificial Sequence; identical to SEQ ID NO: 265
  Synthetic Polynucloetide encoding a vL fragment

SEQ ID NO: 8046 - DNA, 321 bp, Artificial Sequence; identical to SEQ ID NO: 266
  Synthetic Polynucloetide encoding a vL fragment

SEQ ID NO: 8047 - DNA, 339 bp, Artificial Sequence; identical to SEQ ID NO: 267
  Synthetic Polynucloetide encoding a vL fragment

SEQ ID NO: 8048 - DNA, 318 bp, Artificial Sequence; identical to SEQ ID NO: 268
  Synthetic Polynucloetide encoding a vL fragment

SEQ ID NO: 8049 - DNA, 336 bp, Artificial Sequence; identical to SEQ ID NO: 269
  Synthetic Polynucloetide encoding a vL fragment

SEQ ID NO: 8050 - DNA, 330 bp, Artificial Sequence; identical to SEQ ID NO: 270
  Synthetic Polynucloetide encoding a vL fragment

SEQ ID NO: 8051 - DNA, 336 bp, Artificial Sequence; identical to SEQ ID NO: 271
  Synthetic Polynucloetide encoding a vL fragment

SEQ ID NO: 8052 - DNA, 333 bp, Artificial Sequence; identical to SEQ ID NO: 555
  Synthetic Polynucloetide encoding a vL fragment

SEQ ID NO: 8053 - DNA, 321 bp, Artificial Sequence; identical to SEQ ID NO: 273
  Synthetic Polynucloetide encoding a vL fragment

SEQ ID NO: 8054 - DNA, 327 bp, Artificial Sequence; identical to SEQ ID NO: 274
  Synthetic Polynucloetide encoding a vL fragment

SEQ ID NO: 8055 - DNA, 321 bp, Artificial Sequence; identical to SEQ ID NO: 275
  Synthetic Polynucloetide encoding a vL fragment

SEQ ID NO: 8056 - DNA, 324 bp, Artificial Sequence; identical to SEQ ID NO: 276
  Synthetic Polynucloetide encoding a vL fragment

SEQ ID NO: 8057 - DNA, 324 bp, Artificial Sequence; identical to SEQ ID NO: 277
  Synthetic Polynucloetide encoding a vL fragment

SEQ ID NO: 8058 - DNA, 321 bp, Artificial Sequence
  Synthetic Polynucloetide encoding a vL fragment
gagatcgtgctgacacagtctcccgccacactgtcactgtctccaggcgaaagagccacactgagctgtagagccagcgagaacgtgtacagctacctggcctggtatcagcagaagccaggacaggctccccggctgctgatctactttgccaagacactggccgagggcatccccgccagattttctggttctggcagcggcaccgatttcaccctgaccataagcagcctggaacctgaggacttcgccgtgtactattgccagcaccacagcgacaacccctggacctttggacagggcaccaaggtggaaatcaag

SEQ ID NO: 8059 - DNA, 324 bp, Artificial Sequence
  Synthetic Polynucloetide encoding a vL fragment
gacatccagatgacacagagccctagcagcctgtctgccagcgtgggagacagagtgaccatcacctgtcggaccagcgagaacgtgtacagctacctggcctggtatcagcagaagcctggcaaggcccctaagctgctggtgtcctttgccaagacactggccgaaggcgtgcccagcagattttctggctctggcagcggcaccgacttcaccctgaccatatctagcctgcagcctgaggacttcgccacctacttttgccagcaccacagcgacaacccctggacctttggacagggcaccaaggtggaaatcaagaga

SEQ ID NO: 8060 - DNA, 324 bp, Artificial Sequence
  Synthetic Polynucloetide encoding a vL fragment
gagatcgtgctgacacagagccctggcacactgtcactgtctccaggcgaaggcgctaccctgtcttgtagagctggacagtctgtgcggagcagctacctcggatggtatcagcagaagcctggacaggcccctcggctgttgatctacggtgcttctagcagagccacaggcatccccgatagattttctggcagcggctccggcaccgacttcaccctgacaatcagcagactggaacccgaggacttcgccgtgtactactgtcagcagtacggctacagccctcctacctttggctgcggcaccaagctggaaatcaaa

SEQ ID NO: 8061 - DNA, 324 bp, Artificial Sequence
  Synthetic Polynucloetide encoding a vL fragment
gaaatcgtgctgacacagagccccggcacactgtctcttagccctggcgaaagagccacactgagctgtagagccagccagagcatcagaagcagctacctggcctggtatcagcagaagcctggacaggctccccggctgttgatctacggtgcttctagcagagccacaggcatccccgatagattttctggcagcggctccggcaccgacttcaccctgacaatcagcagactggaacccgaggactttgccgtgtattactgccagcagtacggcgacctgcctttcacctttggctgcggcaccaagctggaaatcaag

SEQ ID NO: 8062 - DNA, 324 bp, Artificial Sequence
  Synthetic Polynucloetide encoding a vL fragment
gaaatcgtgctgacacagagccccggcacactgtctcttagccctggcgaaagagccacactgagctgtagagcctctcagagcgtgcggagcacatacctggcttggtatcagcagaagcccggccaggctcctagactgctgatctacggtgccagcagcagagccacaggcatccccgatagattttctggcagcggctccggcaccgacttcaccctgacaatcagcagactggaacccgaggactttgccgtgtacagctgtcagcagtacggcgacctgcctttcacctttggctgcggcaccaagctggaaatcaag

SEQ ID NO: 8063 - DNA, 324 bp, Artificial Sequence
  Synthetic Polynucloetide encoding a vL fragment
gagatcgtgctgacacagagccctggcacactgtcactgtctccaggcgaaagagccacactgagctgtagagcctctcagagcgtgcggggcaattacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgtcagcagtacggctacagccccttcacctttggctgtggcaccaaggtggaaatcaaa

SEQ ID NO: 8064 - DNA, 330 bp, Artificial Sequence
  Synthetic Polynucloetide encoding a vL fragment
gagatcgtgatgacacagagccccgccacactgtcactgtctccaggcgaaagagccacacctagctgtagagccagccagagcgtgtcctcttacctggcctggtatcagcagaagcctggacaggctccccggctgctgatctacgatgccagcaatagagccacaggcatccccgtgcggtttagcggatctggctctggcaccgatttcaccctgaccataagcagcctggaacctgaggacttcgccgtgtactactgcctccagaggaccaactggcctctgacctttggacagggcaccaaggtggaaatcaagcggacagtt

SEQ ID NO: 8065 - DNA, 321 bp, Artificial Sequence
  Synthetic Polynucloetide encoding a vL fragment
gaaattgtgctgacccagtctcctgccacactgtctcttagccctggcgagagagccacactgagctgtagagccagccagagcgtgtcctcttacctggcttggtatcagcagaagcccggacaggctcccagactgctgatcttcgacgccagcaatagagccacaggcatccccgccagattttccggctctggctctggcaccgatttcaccctgaccataagcagcctggaacctgaggacttcgccgtgtattattgccagcagcggagcaactggcccctgacatttggaggcggcaccaaggtggaaatcaag

SEQ ID NO: 8066 - DNA, 321 bp, Artificial Sequence
  Synthetic Polynucloetide encoding a vL fragment
gccattcagctgacacagagcccttctagcctgagcgcctctgtgggcgacagagtgaccatcacatgtagagccagccagggcatctcttctgccctggcatggtatcagcagaagcctggcaaggcccctaagttcctgatctacgacgccagcagcctggaaagcggagtgcctagcagattttctggcagcggctccggcaccgatttcaccctgacaatatccagcctccagcctgaggacttcgccacctactactgccagcagttcaacagctaccccttcaccttcggacccggcaccaaggtggacatcaaa

SEQ ID NO: 8067 - DNA, 324 bp, Artificial Sequence
  Synthetic Polynucloetide encoding a vL fragment
gagatcgtgctgacacagagccctggcacactgtcactgtctccaggcgaaagagccacactgagctgtagagcctctcagagcgtgcggtctagctacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgtcagcagtacggcgacctgcctttcacctttggctgtggcaccaaggtggaaatcaaa

SEQ ID NO: 8068 - DNA, 324 bp, Artificial Sequence
  Synthetic Polynucloetide encoding a vL fragment
gagatcgtgctgacacagagccctggcacactgtcactgtctccaggcgaaagagccacactgagctgtagagcctctcagagcgtgcggagcaattacctggcctggtatcagcagaagcccggacaggctcctcggctgttgatctacggtgcctctagcagagccacaggcatccccgatagattttctggcagcggctccggcaccgacttcaccctgacaatcagcagactggaacccgaggacttcgccgtgtactactgtcagcagtacggcgacctgcctttcacatttggcccaggcaccaaggtggaaatcaaa

SEQ ID NO: 8069 - DNA, 300 bp, Artificial Sequence
  Synthetic Polynucloetide encoding a vL fragment
cagtctgctctgacccagcctagaagcgtgtcagcctctcctggacagagcgtgaccatcagctgtaccggcacacacaactacgtgtcctggtgccagcagaagcctggacaggctcctaagctgctgatctacgacttcaacaagcggcccagcggcgtgtccgatagattttctggcagcaccagcggcaacaccgccagcctgacaatctctggactgcaagccgatgacgagggccactacttctgttgggccttcgagaatatcggcggaggcaccaagctgacagtgcttggc

SEQ ID NO: 8070 - DNA, 300 bp, Artificial Sequence
  Synthetic Polynucloetide encoding a vL fragment
cagtctgctctgacccagcctagaagcgtgtcagcctctcctggacagagcgtgaccatcagctgtaccggcacacacaacctggtgtcctggtgtcagcatcagcctggcagagcccctaagctgctgatctacgacttcaacaagcggcctagcggcgtgcccgatagattttctggatctggctctggcggcaccgccagcctgacaattactggcctccaggacgacgacgatgccgagtatttctgctgggcctacgaagcctttggcggaggcacaaagctgacagtgcttgga

SEQ ID NO: 8071 - DNA, 300 bp, Artificial Sequence
  Synthetic Polynucloetide encoding a vL fragment
cagtgtgtgctgacccagcctagatccgtgtctggctctcctggacagagcgtgaccatcagctgtaccggcacacacaactacgtgtcctggtgccagcaccatcctggcaatgcccctaagctgctgctgtacgacttcgacaaacggcccagcggcatcagcgatagattcagcggaagcagaagcggcaacaccgccagcctgacaatctctggactccagcctgaggacgaggccgactacttctgctgggcctttgaagcctttggcggaggcacaaaggtgctggttcttaga

SEQ ID NO: 8072 - DNA, 300 bp, Artificial Sequence
  Synthetic Polynucloetide encoding a vL fragment
tacgtgcagagccagtctcctagcacactgtacgccagcgtgggcgacaagatcaccatcacctgtagaagcagccagagcggctggaaagcctggtatcagcagaagcctggcaaggcccctaagctgctgatctacaagagcagcatcctggaaaccggcgtgcccagcagattttccggcagcgatagcggcaccgagttcaccctgacaatcagcagcctccagcctgacgacttcgccacctactactgccagcacttcgagacattcggccagggcaccagagtgcaagttcgc

SEQ ID NO: 8073 - DNA, 300 bp, Artificial Sequence; identical to SEQ ID NO: 8072
  Synthetic Polynucloetide encoding a vL fragment

SEQ ID NO: 8074 - DNA, 303 bp, Artificial Sequence
  Synthetic Polynucloetide encoding a vL fragment
gcatctgccctgactcagcctgcctccatgtctgcgtcccctggacagtcggtaaccatctcgtgctctggaaccagacacataatctctgcttggttccaacaatatccaggcaaaccacccaaactcataatttttgacgacgataagcgtccctctggagttcctagtcgcttctctgcctccaggcctggcgacacggcctccctgacaatctctaatgttcaacctgaggacgaggcgacgtacatttgcaatacatatgaattctttggcggagggaccagattgaccgtcctaagt

SEQ ID NO: 8075 - DNA, 300 bp, Artificial Sequence
  Synthetic Polynucloetide encoding a vL fragment
tacatccaggtgacccagtctccttccaccctgtctgcatctataggagacacagtcaccatcacttgccgggccagtgagggttggttggcctggtatcagcagaaaccagggaaagcccctaagctcataatttataagacctccactttggaaagaggggtcccatcaaggttcagcggcagtgtatctggggcagacttcactctcaccatcagcggcctgcagtctgatgattttgcaacttattactgccaaaagtttgaattttttggccaggggaccgtggtggacatgaaa

SEQ ID NO: 8076 - DNA, 300 bp, Artificial Sequence; identical to SEQ ID NO: 8075
  Synthetic Polynucloetide encoding a vL fragment

SEQ ID NO: 8077 - DNA, 324 bp, Artificial Sequence
  Synthetic Polynucloetide encoding a vL fragment
gaaaatgtgttgacgcagtctccaggcaccctgtctttgtctccaggggatagagccaccctctcctgcagggccagtcagagttttagcagcagcaacttagcctggtaccagcagaaacctggccaggctcccaggctcctcatccatggtgtatccaccagggccactggcatcccagacaggttcagtggcagtgggtctgggacagacttcactctcaccatcagcagactggagcctgaagattttgcagtgtatttctgtcagcagtatgcttactcacctgcgacgttcggccaagggaccaaggtggaaatcaaa

SEQ ID NO: 8078 - DNA, 324 bp, Artificial Sequence
  Synthetic Polynucloetide encoding a vL fragment
gaaaatgtgttgacgcagtctccaggcaccctgtctttgtctccaggggacagagccaccctctcctgcagggccagtcagagttttagcagcagctacttagcctggtaccagcagaaacctggccaggctcccaggctcctcatctatggtgtatccaccagggccactggcatcccagacaggttcagtggcagtgggtctgggacagacttcactctcaccatcagcagactggagcctgaagattttgcagtgtatttctgtcagcagtatgcttactcacctgcgacgttcggccaagggaccaaggtggaaatcaaa

SEQ ID NO: 8079 - DNA, 321 bp, Artificial Sequence
  Synthetic Polynucloetide encoding a vL fragment
gaaattgtgttgacgcagtctccaggcaccctgtctttgtctccaggggaaagagccaccctctcctgcaggaccagtcagactgttcgcagcagcttcttagcctggtaccagcagaaacctggccaggctcccagtctcctcatctatggtacatccagcagggccactggcatcccagacaggttcagtggcagtgggtctgggacagacttcactctcaccatcagcggactggagcctgaagattctgcagtgtattactgtcagcagtatggtagctcacttactttcggcggagggaccaaggtggagatcaaa

SEQ ID NO: 8080 - DNA, 321 bp, Artificial Sequence
  Synthetic Polynucloetide encoding a vL fragment
gaaattctgttgacgcagtctccaggcaccctgtctttgtctccaggggaaagagccaccctctcctgcagggccagtcagagtgttagcaccaagtacttagcctggtaccagcagaaacctggccaggctcccaggctcctcatctatggtgcatccagcagggccactggcatcccagacaggttcactggcagtgggtctgggacagacttcactctcaccatcaccagactggagcctgaagattttgcagtgtattactgtcagcagtatggtcgctcacttacattcggcccagggaccaaggtggacctcaaa

SEQ ID NO: 8081 - DNA, 324 bp, Artificial Sequence
  Synthetic Polynucloetide encoding a vL fragment
gaaattgtgttgacgcagtttccaggcaccctgtctttgtctccaggggaaggagccaccctctcctgcagggccagtcagagtattagcagcagccagttagcctggtaccagcagagacctggccaggctcccaggctcctcatctatggtgcatccagcagggccactgccatcccagacaggttcagtggcagtgggtctgggacagacttcactctcaccatcagcagactggagcctgaagattttggagtgtattactgtcagcagtatggtcgctcacttatcaccttcggccaagggacacgactggagattaaa

SEQ ID NO: 8082 - DNA, 324 bp, Artificial Sequence
  Synthetic Polynucloetide encoding a vL fragment
gaaattgtgttgacgcagtttccaggcaccctgtctttgtctccaggggaaggagccaccctctcctgcagggccagtcagagtattagcagcagccagttagcctggtaccagcagagacctggccaggctcccaggctcctcatctatggtgcatccagcagggccactgccatcccagacaggttcagtggcagtgggtctgggacagacttcactctcaccatcagcagactggagcctgaagattttgcagtgtattactgtcagcagtatggtcgctcacttatcaccttcggccaagggacacgactggagattaaa

SEQ ID NO: 8083 - DNA, 324 bp, Artificial Sequence
  Synthetic Polynucloetide encoding a vL fragment
gaaattgtgttgacgcagtttccaggcaccctgtctttgtctccaggggaaagagccaccctctcctgcagggccagtcagagtgttagcagcaactacttagcctggtaccagcagaaacctggccaggctcccaggctcctcatctatggtgcatccagcagggccactgccatcccagacaggttcagtggcagtgggtctgggacagacttcactctcaccatcagcagactggagcctgaagatgttgcagtgtattactgtcagcagtatggtcgctcacttatcaccttcggccaagggacacgactggagattaaa

SEQ ID NO: 8084 - DNA, 324 bp, Artificial Sequence
  Synthetic Polynucloetide encoding a vL fragment
gaaattgtgttgacgcagtttccaggcaccctgtctttgtctccaggggaaagagccaccctctcctgcagggccagtcagagtgttagcagcagccaattagcctggtaccagcagaaacctggccaggctcccaggctcctcatctatggtgcatccagcagggccactgccatcccagacaggttcagtggcagtgggtctgggacagacttcactctcaccatcagcagactggagcctgaagattttgcagtgtattactgtcagcagtatggtcgcttacttatcaccttcggccaagggacacgactggagattaaa

SEQ ID NO: 8085 - DNA, 327 bp, Artificial Sequence
  Synthetic Polynucloetide encoding a vL fragment
gaaattgtgttgacgcagtctccaggcaccctgtctttgtctccaggggaaacagccaccctctcctgcagggccagtcagagtgttgtcagcaactacttagcctggtaccagcagaagcctggccaggctcccaggctcctcatctatggtgcatctagaagggccactgccatcccagacaggttcagtggcagtgggtctgggacagagttcactctcaccatcagcagactggagcctgaagattttgcagtctattactgtcagcagtatggtagctcacctcaggtctctttcggcggagggaccaaggtggagatcaaa

SEQ ID NO: 8086 - DNA, 330 bp, Artificial Sequence
  Synthetic Polynucloetide encoding a vL fragment
agttttatgctgactcagtccctctctgtgtcggagtctccggggaagacggtaaccatctcctgcacccgcagcagtggcaccattgccaccaactatgtgcagtggtaccagcagcgcccgggcagtgcccccaccactgtgatctttgagaatgaccgaagaccctctggggtccctgatcggttctctggctccatcgacacctcctccaactctgcctccctcaccatctctggactgaagactgaggacgaggctgactactactgtcagtcttatgataccaccgatgtgatattcggcggagggaccaagctgaccgtccta

SEQ ID NO: 8087 - DNA, 330 bp, Artificial Sequence
  Synthetic Polynucloetide encoding a vL fragment
agttttatgctgactcagtccctctctgtgtcggagtctccggggaagacggtaaccatctcctgcacccgcagcagtggcaccattgccaccaactatgtgcagtggtaccagcagcgcccgggcagtgcccccaccactatcatctttgagaatgaccgaagaccctctggggtccctgatcggttctctggctccatcgacacctcctccaactctgcctccctcaccatctctggactgaggactgaggacgaggctgactactactgtcagtcttatgataccaccgatgtgatattcggcggagggaccaagctgaccgtccta

SEQ ID NO: 8088 - DNA, 321 bp, Artificial Sequence
  Synthetic Polynucloetide encoding a vL fragment
gacatccagatgacacagagccctagcagcctgtctgccagcgtgggagacagagtgaccatcacctgtagagccagcgtgaacatctacagctacctggcctggtatcagcagaagcctggcaaggcccctaagctgctgatctacaacgccaagattctggccgagggcgtgcccagcagattttctggttctggcagcggcaccgacttcaccctgacaatatctagcctccagcctgaggacttcgccacctactactgccagcaccactacggcaccttcacctttggcggcggaacaaaggtggaaatcaagaga

SEQ ID NO: 8089 - DNA, 324 bp, Artificial Sequence
  Synthetic Polynucloetide encoding a vL fragment
gagatcgtgctgacacagagccctggcacactgtcactgtctccaggcgaaagagccacactgagctgcaaggccagccagaacgtgggcaacaacgtggcctggtatcagcagaagcctggacaggctccccggctgctgatctacagcgccagctacagatacagcggcatccccgatagattcagcggctctggcagcggcaccgatttcaccctgaccatcagcagactggaacccgaggacttcgccgtgtactactgccagcagtacaacacataccccttcaccttcggccagggcacaagactggaaatcaagaga

SEQ ID NO: 8090 - DNA, 336 bp, Artificial Sequence
  Synthetic Polynucloetide encoding a vL fragment
gacatcgtgctgacacagagccctgcttctctggccgtgtctctgggagagagagccaccatcaactgtagagccagcgagagcgtgtccgtgattggagcccacctgatccactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggaccatccccagaacattcggccagggcaccaagctggaaatcaagaga

SEQ ID NO: 8091 - DNA, 336 bp, Artificial Sequence
  Synthetic Polynucloetide encoding a vL fragment
gacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttccggcagcggcagcagaaccgacttcaccctgaccatcagcagcgtggaacccgaggacttcgccgtgtactactgcctccagagccggaccatccccagaacattcggccagggcaccaagctggaaatcaagaga

SEQ ID NO: 8092 - DNA, 336 bp, Artificial Sequence
  Synthetic Polynucloetide encoding a vL fragment
gacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggaccatccccagaacattcggccagggcaccaagctggaaatcaagaga

SEQ ID NO: 8093 - DNA, 333 bp, Artificial Sequence
  Synthetic Polynucloetide encoding a vL fragment
gacatcgtgctgacacagagccctgccaccctgtctctgagccctggcgatagagccaccatcagctgtagagccagcgagagcgtgaccatcctgggcagccacctgatctactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaa

SEQ ID NO: 8094 - DNA, 333 bp, Artificial Sequence
  Synthetic Polynucloetide encoding a vL fragment
gacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaa

SEQ ID NO: 8095 - DNA, 333 bp, Artificial Sequence
  Synthetic Polynucloetide encoding a vL fragment
gacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggatcttccccagaacctttggacagggcaccaagctggaaatcaaa

SEQ ID NO: 8096 - DNA, 333 bp, Artificial Sequence
  Synthetic Polynucloetide encoding a vL fragment
gacatcgtgctgacacagagccctgcttctctggccgtgtctctgggagagagagccaccatcaactgtagagccagcgagagcgtgtccgtgattggagcccacctgatccactggtatcagcagaagcccggccagccccccagactgctgattcagctggcctccaatgtgcagaccggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaa

SEQ ID NO: 8097 - DNA, 321 bp, Artificial Sequence; identical to SEQ ID NO: 259
  Synthetic Polynucloetide encoding a vL fragment

SEQ ID NO: 8098 - DNA, 375 bp, Artificial Sequence; identical to SEQ ID NO: 297
  Synthetic Polynucleotide encoding a heavy chain variable (vH) fragment

SEQ ID NO: 8099 - DNA, 360 bp, Artificial Sequence; identical to SEQ ID NO: 298
  Synthetic Polynucleotide encoding a heavy chain variable (vH) fragment

SEQ ID NO: 8100 - DNA, 369 bp, Artificial Sequence; identical to SEQ ID NO: 299
  Synthetic Polynucleotide encoding a heavy chain variable (vH) fragment

SEQ ID NO: 8101 - DNA, 354 bp, Artificial Sequence; identical to SEQ ID NO: 300
  Synthetic Polynucleotide encoding a heavy chain variable (vH) fragment

SEQ ID NO: 8102 - DNA, 351 bp, Artificial Sequence; identical to SEQ ID NO: 301
  Synthetic Polynucleotide encoding a heavy chain variable (vH) fragment

SEQ ID NO: 8103 - DNA, 351 bp, Artificial Sequence; identical to SEQ ID NO: 302
  Synthetic Polynucleotide encoding a heavy chain variable (vH) fragment

SEQ ID NO: 8104 - DNA, 363 bp, Artificial Sequence; identical to SEQ ID NO: 303
  Synthetic Polynucleotide encoding a heavy chain variable (vH) fragment

SEQ ID NO: 8105 - DNA, 354 bp, Artificial Sequence; identical to SEQ ID NO: 307
  Synthetic Polynucleotide encoding a heavy chain variable (vH) fragment

SEQ ID NO: 8106 - DNA, 360 bp, Artificial Sequence; identical to SEQ ID NO: 308
  Synthetic Polynucleotide encoding a heavy chain variable (vH) fragment

SEQ ID NO: 8107 - DNA, 366 bp, Artificial Sequence; identical to SEQ ID NO: 321
  Synthetic Polynucleotide encoding a heavy chain variable (vH) fragment

SEQ ID NO: 8108 - DNA, 354 bp, Artificial Sequence; identical to SEQ ID NO: 322
  Synthetic Polynucleotide encoding a heavy chain variable (vH) fragment

SEQ ID NO: 8109 - DNA, 363 bp, Artificial Sequence; identical to SEQ ID NO: 323
  Synthetic Polynucleotide encoding a heavy chain variable (vH) fragment

SEQ ID NO: 8110 - DNA, 360 bp, Artificial Sequence; identical to SEQ ID NO: 324
  Synthetic Polynucleotide encoding a heavy chain variable (vH) fragment

SEQ ID NO: 8111 - DNA, 360 bp, Artificial Sequence; identical to SEQ ID NO: 325
  Synthetic Polynucleotide encoding a heavy chain variable (vH) fragment

SEQ ID NO: 8112 - DNA, 372 bp, Artificial Sequence; identical to SEQ ID NO: 326
  Synthetic Polynucleotide encoding a heavy chain variable (vH) fragment

SEQ ID NO: 8113 - DNA, 360 bp, Artificial Sequence; identical to SEQ ID NO: 327
  Synthetic Polynucleotide encoding a heavy chain variable (vH) fragment

SEQ ID NO: 8114 - DNA, 357 bp, Artificial Sequence; identical to SEQ ID NO: 328
  Synthetic Polynucleotide encoding a heavy chain variable (vH) fragment

SEQ ID NO: 8115 - DNA, 360 bp, Artificial Sequence; identical to SEQ ID NO: 329
  Synthetic Polynucleotide encoding a heavy chain variable (vH) fragment

SEQ ID NO: 8116 - DNA, 366 bp, Artificial Sequence; identical to SEQ ID NO: 339
  Synthetic Polynucleotide encoding a heavy chain variable (vH) fragment

SEQ ID NO: 8117 - DNA, 357 bp, Artificial Sequence; identical to SEQ ID NO: 340
  Synthetic Polynucleotide encoding a heavy chain variable (vH) fragment

SEQ ID NO: 8118 - DNA, 360 bp, Artificial Sequence; identical to SEQ ID NO: 352
  Synthetic Polynucleotide encoding a heavy chain variable (vH) fragment

SEQ ID NO: 8119 - DNA, 351 bp, Artificial Sequence; identical to SEQ ID NO: 353
  Synthetic Polynucleotide encoding a heavy chain variable (vH) fragment

SEQ ID NO: 8120 - DNA, 372 bp, Artificial Sequence; identical to SEQ ID NO: 354
  Synthetic Polynucleotide encoding a heavy chain variable (vH) fragment

SEQ ID NO: 8121 - DNA, 351 bp, Artificial Sequence; identical to SEQ ID NO: 355
  Synthetic Polynucleotide encoding a heavy chain variable (vH) fragment

SEQ ID NO: 8122 - DNA, 336 bp, Artificial Sequence; identical to SEQ ID NO: 356
  Synthetic Polynucleotide encoding a heavy chain variable (vH) fragment

SEQ ID NO: 8123 - DNA, 351 bp, Artificial Sequence; identical to SEQ ID NO: 357
  Synthetic Polynucleotide encoding a heavy chain variable (vH) fragment

SEQ ID NO: 8124 - DNA, 357 bp, Artificial Sequence; identical to SEQ ID NO: 358
  Synthetic Polynucleotide encoding a heavy chain variable (vH) fragment

SEQ ID NO: 8125 - DNA, 360 bp, Artificial Sequence; identical to SEQ ID NO: 359
  Synthetic Polynucleotide encoding a heavy chain variable (vH) fragment

SEQ ID NO: 8126 - DNA, 348 bp, Artificial Sequence; identical to SEQ ID NO: 360
  Synthetic Polynucleotide encoding a heavy chain variable (vH) fragment

SEQ ID NO: 8127 - DNA, 354 bp, Artificial Sequence; identical to SEQ ID NO: 361
  Synthetic Polynucleotide encoding a heavy chain variable (vH) fragment

SEQ ID NO: 8128 - DNA, 366 bp, Artificial Sequence; identical to SEQ ID NO: 362
  Synthetic Polynucleotide encoding a heavy chain variable (vH) fragment

SEQ ID NO: 8129 - DNA, 366 bp, Artificial Sequence; identical to SEQ ID NO: 370
  Synthetic Polynucleotide encoding a heavy chain variable (vH) fragment

SEQ ID NO: 8130 - DNA, 342 bp, Artificial Sequence; identical to SEQ ID NO: 371
  Synthetic Polynucleotide encoding a heavy chain variable (vH) fragment

SEQ ID NO: 8131 - DNA, 363 bp, Artificial Sequence; identical to SEQ ID NO: 372
  Synthetic Polynucleotide encoding a heavy chain variable (vH) fragment

SEQ ID NO: 8132 - DNA, 363 bp, Artificial Sequence; identical to SEQ ID NO: 372
  Synthetic Polynucleotide encoding a heavy chain variable (vH) fragment

SEQ ID NO: 8133 - DNA, 354 bp, Artificial Sequence; identical to SEQ ID NO: 374
  Synthetic Polynucleotide encoding a heavy chain variable (vH) fragment

SEQ ID NO: 8134 - DNA, 339 bp, Artificial Sequence; identical to SEQ ID NO: 375
  Synthetic Polynucleotide encoding a heavy chain variable (vH) fragment

SEQ ID NO: 8135 - DNA, 351 bp, Artificial Sequence; identical to SEQ ID NO: 376
  Synthetic Polynucleotide encoding a heavy chain variable (vH) fragment

SEQ ID NO: 8136 - DNA, 369 bp, Artificial Sequence; identical to SEQ ID NO: 378
  Synthetic Polynucleotide encoding a heavy chain variable (vH) fragment

SEQ ID NO: 8137 - DNA, 375 bp, Artificial Sequence; identical to SEQ ID NO: 379
  Synthetic Polynucleotide encoding a heavy chain variable (vH) fragment

SEQ ID NO: 8138 - DNA, 348 bp, Artificial Sequence; identical to SEQ ID NO: 380
  Synthetic Polynucleotide encoding a heavy chain variable (vH) fragment

SEQ ID NO: 8139 - DNA, 354 bp, Artificial Sequence; identical to SEQ ID NO: 381
  Synthetic Polynucleotide encoding a heavy chain variable (vH) fragment

SEQ ID NO: 8140 - DNA, 354 bp, Artificial Sequence; identical to SEQ ID NO: 382
  Synthetic Polynucleotide encoding a heavy chain variable (vH) fragment

SEQ ID NO: 8141 - DNA, 345 bp, Artificial Sequence; identical to SEQ ID NO: 383
  Synthetic Polynucleotide encoding a heavy chain variable (vH) fragment

SEQ ID NO: 8142 - DNA, 360 bp, Artificial Sequence; identical to SEQ ID NO: 384
  Synthetic Polynucleotide encoding a heavy chain variable (vH) fragment

SEQ ID NO: 8143 - DNA, 360 bp, Artificial Sequence; identical to SEQ ID NO: 385
  Synthetic Polynucleotide encoding a heavy chain variable (vH) fragment

SEQ ID NO: 8144 - DNA, 366 bp, Artificial Sequence; identical to SEQ ID NO: 390
  Synthetic Polynucleotide encoding a heavy chain variable (vH) fragment

SEQ ID NO: 8145 - DNA, 366 bp, Artificial Sequence; identical to SEQ ID NO: 391
  Synthetic Polynucleotide encoding a heavy chain variable (vH) fragment

SEQ ID NO: 8146 - DNA, 357 bp, Artificial Sequence; identical to SEQ ID NO: 392
  Synthetic Polynucleotide encoding a heavy chain variable (vH) fragment

SEQ ID NO: 8147 - DNA, 360 bp, Artificial Sequence; identical to SEQ ID NO: 393
  Synthetic Polynucleotide encoding a heavy chain variable (vH) fragment

SEQ ID NO: 8148 - DNA, 360 bp, Artificial Sequence; identical to SEQ ID NO: 400
  Synthetic Polynucleotide encoding a heavy chain variable (vH) fragment

SEQ ID NO: 8149 - DNA, 360 bp, Artificial Sequence; identical to SEQ ID NO: 401
  Synthetic Polynucleotide encoding a heavy chain variable (vH) fragment

SEQ ID NO: 8150 - DNA, 372 bp, Artificial Sequence; identical to SEQ ID NO: 402
  Synthetic Polynucleotide encoding a heavy chain variable (vH) fragment

SEQ ID NO: 8151 - DNA, 354 bp, Artificial Sequence; identical to SEQ ID NO: 403
  Synthetic Polynucleotide encoding a heavy chain variable (vH) fragment

SEQ ID NO: 8152 - DNA, 345 bp, Artificial Sequence; identical to SEQ ID NO: 404
  Synthetic Polynucleotide encoding a heavy chain variable (vH) fragment

SEQ ID NO: 8153 - DNA, 357 bp, Artificial Sequence; identical to SEQ ID NO: 405
  Synthetic Polynucleotide encoding a heavy chain variable (vH) fragment

SEQ ID NO: 8154 - DNA, 369 bp, Artificial Sequence; identical to SEQ ID NO: 406
  Synthetic Polynucleotide encoding a heavy chain variable (vH) fragment

SEQ ID NO: 8155 - DNA, 348 bp, Artificial Sequence; identical to SEQ ID NO: 407
  Synthetic Polynucleotide encoding a heavy chain variable (vH) fragment

SEQ ID NO: 8156 - DNA, 342 bp, Artificial Sequence; identical to SEQ ID NO: 408
  Synthetic Polynucleotide encoding a heavy chain variable (vH) fragment

SEQ ID NO: 8157 - DNA, 381 bp, Artificial Sequence; identical to SEQ ID NO: 409
  Synthetic Polynucleotide encoding a heavy chain variable (vH) fragment

SEQ ID NO: 8158 - DNA, 360 bp, Artificial Sequence; identical to SEQ ID NO: 410
  Synthetic Polynucleotide encoding a heavy chain variable (vH) fragment

SEQ ID NO: 8159 - DNA, 351 bp, Artificial Sequence; identical to SEQ ID NO: 411
  Synthetic Polynucleotide encoding a heavy chain variable (vH) fragment

SEQ ID NO: 8160 - DNA, 372 bp, Artificial Sequence; identical to SEQ ID NO: 414
  Synthetic Polynucleotide encoding a heavy chain variable (vH) fragment

SEQ ID NO: 8161 - DNA, 366 bp, Artificial Sequence; identical to SEQ ID NO: 415
  Synthetic Polynucleotide encoding a heavy chain variable (vH) fragment

SEQ ID NO: 8162 - DNA, 354 bp, Artificial Sequence; identical to SEQ ID NO: 416
  Synthetic Polynucleotide encoding a heavy chain variable (vH) fragment

SEQ ID NO: 8163 - DNA, 372 bp, Artificial Sequence; identical to SEQ ID NO: 417
  Synthetic Polynucleotide encoding a heavy chain variable (vH) fragment

SEQ ID NO: 8164 - DNA, 339 bp, Artificial Sequence; identical to SEQ ID NO: 418
  Synthetic Polynucleotide encoding a heavy chain variable (vH) fragment

SEQ ID NO: 8165 - DNA, 363 bp, Artificial Sequence; identical to SEQ ID NO: 419
  Synthetic Polynucleotide encoding a heavy chain variable (vH) fragment

SEQ ID NO: 8166 - DNA, 357 bp, Artificial Sequence; identical to SEQ ID NO: 420
  Synthetic Polynucleotide encoding a heavy chain variable (vH) fragment

SEQ ID NO: 8167 - DNA, 369 bp, Artificial Sequence; identical to SEQ ID NO: 421
  Synthetic Polynucleotide encoding a heavy chain variable (vH) fragment

SEQ ID NO: 8168 - DNA, 354 bp, Artificial Sequence; identical to SEQ ID NO: 422
  Synthetic Polynucleotide encoding a heavy chain variable (vH) fragment

SEQ ID NO: 8169 - DNA, 363 bp, Artificial Sequence; identical to SEQ ID NO: 423
  Synthetic Polynucleotide encoding a heavy chain variable (vH) fragment

SEQ ID NO: 8170 - DNA, 366 bp, Artificial Sequence; identical to SEQ ID NO: 424
  Synthetic Polynucleotide encoding a heavy chain variable (vH) fragment

SEQ ID NO: 8171 - DNA, 372 bp, Artificial Sequence; identical to SEQ ID NO: 425
  Synthetic Polynucleotide encoding a heavy chain variable (vH) fragment

SEQ ID NO: 8172 - DNA, 357 bp, Artificial Sequence; identical to SEQ ID NO: 426
  Synthetic Polynucleotide encoding a heavy chain variable (vH) fragment

SEQ ID NO: 8173 - DNA, 345 bp, Artificial Sequence; identical to SEQ ID NO: 427
  Synthetic Polynucleotide encoding a heavy chain variable (vH) fragment

SEQ ID NO: 8174 - DNA, 357 bp, Artificial Sequence; identical to SEQ ID NO: 428
  Synthetic Polynucleotide encoding a heavy chain variable (vH) fragment

SEQ ID NO: 8175 - DNA, 348 bp, Artificial Sequence; identical to SEQ ID NO: 429
  Synthetic Polynucleotide encoding a heavy chain variable (vH) fragment

SEQ ID NO: 8176 - DNA, 351 bp, Artificial Sequence; identical to SEQ ID NO: 430
  Synthetic Polynucleotide encoding a heavy chain variable (vH) fragment

SEQ ID NO: 8177 - DNA, 360 bp, Artificial Sequence; identical to SEQ ID NO: 433
  Synthetic Polynucleotide encoding a heavy chain variable (vH) fragment

SEQ ID NO: 8178 - DNA, 387 bp, Artificial Sequence; identical to SEQ ID NO: 434
  Synthetic Polynucleotide encoding a heavy chain variable (vH) fragment

SEQ ID NO: 8179 - DNA, 354 bp, Artificial Sequence; identical to SEQ ID NO: 435
  Synthetic Polynucleotide encoding a heavy chain variable (vH) fragment

SEQ ID NO: 8180 - DNA, 405 bp, Artificial Sequence; identical to SEQ ID NO: 436
  Synthetic Polynucleotide encoding a heavy chain variable (vH) fragment

SEQ ID NO: 8181 - DNA, 363 bp, Artificial Sequence; identical to SEQ ID NO: 437
  Synthetic Polynucleotide encoding a heavy chain variable (vH) fragment

SEQ ID NO: 8182 - DNA, 384 bp, Artificial Sequence; identical to SEQ ID NO: 438
  Synthetic Polynucleotide encoding a heavy chain variable (vH) fragment

SEQ ID NO: 8183 - DNA, 366 bp, Artificial Sequence; identical to SEQ ID NO: 440
  Synthetic Polynucleotide encoding a heavy chain variable (vH) fragment

SEQ ID NO: 8184 - DNA, 366 bp, Artificial Sequence; identical to SEQ ID NO: 443
  Synthetic Polynucleotide encoding a heavy chain variable (vH) fragment

SEQ ID NO: 8185 - DNA, 372 bp, Artificial Sequence; identical to SEQ ID NO: 444
  Synthetic Polynucleotide encoding a heavy chain variable (vH) fragment

SEQ ID NO: 8186 - DNA, 354 bp, Artificial Sequence; identical to SEQ ID NO: 445
  Synthetic Polynucleotide encoding a heavy chain variable (vH) fragment

SEQ ID NO: 8187 - DNA, 348 bp, Artificial Sequence; identical to SEQ ID NO: 446
  Synthetic Polynucleotide encoding a heavy chain variable (vH) fragment

SEQ ID NO: 8188 - DNA, 366 bp, Artificial Sequence; identical to SEQ ID NO: 447
  Synthetic Polynucleotide encoding a heavy chain variable (vH) fragment

SEQ ID NO: 8189 - DNA, 357 bp, Artificial Sequence; identical to SEQ ID NO: 167
  Synthetic Polynucleotide encoding a heavy chain variable (vH) fragment

SEQ ID NO: 8190 - DNA, 384 bp, Artificial Sequence; identical to SEQ ID NO: 449
  Synthetic Polynucleotide encoding a heavy chain variable (vH) fragment

SEQ ID NO: 8191 - DNA, 363 bp, Artificial Sequence; identical to SEQ ID NO: 450
  Synthetic Polynucleotide encoding a heavy chain variable (vH) fragment

SEQ ID NO: 8192 - DNA, 366 bp, Artificial Sequence; identical to SEQ ID NO: 451
  Synthetic Polynucleotide encoding a heavy chain variable (vH) fragment

SEQ ID NO: 8193 - DNA, 351 bp, Artificial Sequence; identical to SEQ ID NO: 452
  Synthetic Polynucleotide encoding a heavy chain variable (vH) fragment

SEQ ID NO: 8194 - DNA, 354 bp, Artificial Sequence; identical to SEQ ID NO: 453
  Synthetic Polynucleotide encoding a heavy chain variable (vH) fragment

SEQ ID NO: 8195 - DNA, 357 bp, Artificial Sequence; identical to SEQ ID NO: 454
  Synthetic Polynucleotide encoding a heavy chain variable (vH) fragment

SEQ ID NO: 8196 - DNA, 354 bp, Artificial Sequence; identical to SEQ ID NO: 455
  Synthetic Polynucleotide encoding a heavy chain variable (vH) fragment

SEQ ID NO: 8197 - DNA, 357 bp, Artificial Sequence; identical to SEQ ID NO: 456
  Synthetic Polynucleotide encoding a heavy chain variable (vH) fragment

SEQ ID NO: 8198 - DNA, 381 bp, Artificial Sequence; identical to SEQ ID NO: 457
  Synthetic Polynucleotide encoding a heavy chain variable (vH) fragment

SEQ ID NO: 8199 - DNA, 360 bp, Artificial Sequence; identical to SEQ ID NO: 458
  Synthetic Polynucleotide encoding a heavy chain variable (vH) fragment

SEQ ID NO: 8200 - DNA, 354 bp, Artificial Sequence; identical to SEQ ID NO: 459
  Synthetic Polynucleotide encoding a heavy chain variable (vH) fragment

SEQ ID NO: 8201 - DNA, 357 bp, Artificial Sequence; identical to SEQ ID NO: 460
  Synthetic Polynucleotide encoding a heavy chain variable (vH) fragment

SEQ ID NO: 8202 - DNA, 357 bp, Artificial Sequence; identical to SEQ ID NO: 461
  Synthetic Polynucleotide encoding a heavy chain variable (vH) fragment

SEQ ID NO: 8203 - DNA, 354 bp, Artificial Sequence; identical to SEQ ID NO: 462
  Synthetic Polynucleotide encoding a heavy chain variable (vH) fragment

SEQ ID NO: 8204 - DNA, 354 bp, Artificial Sequence; identical to SEQ ID NO: 463
  Synthetic Polynucleotide encoding a heavy chain variable (vH) fragment

SEQ ID NO: 8205 - DNA, 354 bp, Artificial Sequence; identical to SEQ ID NO: 464
  Synthetic Polynucleotide encoding a heavy chain variable (vH) fragment

SEQ ID NO: 8206 - DNA, 360 bp, Artificial Sequence; identical to SEQ ID NO: 465
  Synthetic Polynucleotide encoding a heavy chain variable (vH) fragment

SEQ ID NO: 8207 - DNA, 345 bp, Artificial Sequence; identical to SEQ ID NO: 466
  Synthetic Polynucleotide encoding a heavy chain variable (vH) fragment

SEQ ID NO: 8208 - DNA, 354 bp, Artificial Sequence; identical to SEQ ID NO: 467
  Synthetic Polynucleotide encoding a heavy chain variable (vH) fragment

SEQ ID NO: 8209 - DNA, 339 bp, Artificial Sequence; identical to SEQ ID NO: 468
  Synthetic Polynucleotide encoding a heavy chain variable (vH) fragment

SEQ ID NO: 8210 - DNA, 345 bp, Artificial Sequence; identical to SEQ ID NO: 469
  Synthetic Polynucleotide encoding a heavy chain variable (vH) fragment

SEQ ID NO: 8211 - DNA, 369 bp, Artificial Sequence; identical to SEQ ID NO: 470
  Synthetic Polynucleotide encoding a heavy chain variable (vH) fragment

SEQ ID NO: 8212 - DNA, 363 bp, Artificial Sequence; identical to SEQ ID NO: 471
  Synthetic Polynucleotide encoding a heavy chain variable (vH) fragment

SEQ ID NO: 8213 - DNA, 366 bp, Artificial Sequence; identical to SEQ ID NO: 472
  Synthetic Polynucleotide encoding a heavy chain variable (vH) fragment

SEQ ID NO: 8214 - DNA, 345 bp, Artificial Sequence; identical to SEQ ID NO: 473
  Synthetic Polynucleotide encoding a heavy chain variable (vH) fragment

SEQ ID NO: 8215 - DNA, 342 bp, Artificial Sequence; identical to SEQ ID NO: 474
  Synthetic Polynucleotide encoding a heavy chain variable (vH) fragment

SEQ ID NO: 8216 - DNA, 354 bp, Artificial Sequence; identical to SEQ ID NO: 475
  Synthetic Polynucleotide encoding a heavy chain variable (vH) fragment

SEQ ID NO: 8217 - DNA, 357 bp, Artificial Sequence; identical to SEQ ID NO: 476
  Synthetic Polynucleotide encoding a heavy chain variable (vH) fragment

SEQ ID NO: 8218 - DNA, 339 bp, Artificial Sequence; identical to SEQ ID NO: 477
  Synthetic Polynucleotide encoding a heavy chain variable (vH) fragment

SEQ ID NO: 8219 - DNA, 330 bp, Artificial Sequence; identical to SEQ ID NO: 478
  Synthetic Polynucleotide encoding a heavy chain variable (vH) fragment

SEQ ID NO: 8220 - DNA, 354 bp, Artificial Sequence; identical to SEQ ID NO: 479
  Synthetic Polynucleotide encoding a heavy chain variable (vH) fragment

SEQ ID NO: 8221 - DNA, 345 bp, Artificial Sequence; identical to SEQ ID NO: 480
  Synthetic Polynucleotide encoding a heavy chain variable (vH) fragment

SEQ ID NO: 8222 - DNA, 321 bp, Artificial Sequence; identical to SEQ ID NO: 481
  Synthetic Polynucleotide encoding a heavy chain variable (vH) fragment

SEQ ID NO: 8223 - DNA, 402 bp, Artificial Sequence; identical to SEQ ID NO: 482
  Synthetic Polynucleotide encoding a heavy chain variable (vH) fragment

SEQ ID NO: 8224 - DNA, 390 bp, Artificial Sequence; identical to SEQ ID NO: 483
  Synthetic Polynucleotide encoding a heavy chain variable (vH) fragment

SEQ ID NO: 8225 - DNA, 369 bp, Artificial Sequence; identical to SEQ ID NO: 484
  Synthetic Polynucleotide encoding a heavy chain variable (vH) fragment

SEQ ID NO: 8226 - DNA, 345 bp, Artificial Sequence; identical to SEQ ID NO: 485
  Synthetic Polynucleotide encoding a heavy chain variable (vH) fragment

SEQ ID NO: 8227 - DNA, 360 bp, Artificial Sequence; identical to SEQ ID NO: 486
  Synthetic Polynucleotide encoding a heavy chain variable (vH) fragment

SEQ ID NO: 8228 - DNA, 345 bp, Artificial Sequence; identical to SEQ ID NO: 487
  Synthetic Polynucleotide encoding a heavy chain variable (vH) fragment

SEQ ID NO: 8229 - DNA, 357 bp, Artificial Sequence; identical to SEQ ID NO: 488
  Synthetic Polynucleotide encoding a heavy chain variable (vH) fragment

SEQ ID NO: 8230 - DNA, 360 bp, Artificial Sequence; identical to SEQ ID NO: 489
  Synthetic Polynucleotide encoding a heavy chain variable (vH) fragment

SEQ ID NO: 8231 - DNA, 369 bp, Artificial Sequence; identical to SEQ ID NO: 490
  Synthetic Polynucleotide encoding a heavy chain variable (vH) fragment

SEQ ID NO: 8232 - DNA, 378 bp, Artificial Sequence; identical to SEQ ID NO: 491
  Synthetic Polynucleotide encoding a heavy chain variable (vH) fragment

SEQ ID NO: 8233 - DNA, 357 bp, Artificial Sequence; identical to SEQ ID NO: 492
  Synthetic Polynucleotide encoding a heavy chain variable (vH) fragment

SEQ ID NO: 8234 - DNA, 360 bp, Artificial Sequence; identical to SEQ ID NO: 493
  Synthetic Polynucleotide encoding a heavy chain variable (vH) fragment

SEQ ID NO: 8235 - DNA, 372 bp, Artificial Sequence; identical to SEQ ID NO: 494
  Synthetic Polynucleotide encoding a heavy chain variable (vH) fragment

SEQ ID NO: 8236 - DNA, 357 bp, Artificial Sequence; identical to SEQ ID NO: 495
  Synthetic Polynucleotide encoding a heavy chain variable (vH) fragment

SEQ ID NO: 8237 - DNA, 354 bp, Artificial Sequence; identical to SEQ ID NO: 496
  Synthetic Polynucleotide encoding a heavy chain variable (vH) fragment

SEQ ID NO: 8238 - DNA, 357 bp, Artificial Sequence; identical to SEQ ID NO: 497
  Synthetic Polynucleotide encoding a heavy chain variable (vH) fragment

SEQ ID NO: 8239 - DNA, 369 bp, Artificial Sequence; identical to SEQ ID NO: 498
  Synthetic Polynucleotide encoding a heavy chain variable (vH) fragment

SEQ ID NO: 8240 - DNA, 357 bp, Artificial Sequence; identical to SEQ ID NO: 499
  Synthetic Polynucleotide encoding a heavy chain variable (vH) fragment

SEQ ID NO: 8241 - DNA, 363 bp, Artificial Sequence; identical to SEQ ID NO: 501
  Synthetic Polynucleotide encoding a heavy chain variable (vH) fragment

SEQ ID NO: 8242 - DNA, 369 bp, Artificial Sequence; identical to SEQ ID NO: 502
  Synthetic Polynucleotide encoding a heavy chain variable (vH) fragment

SEQ ID NO: 8243 - DNA, 360 bp, Artificial Sequence; identical to SEQ ID NO: 503
  Synthetic Polynucleotide encoding a heavy chain variable (vH) fragment

SEQ ID NO: 8244 - DNA, 348 bp, Artificial Sequence; identical to SEQ ID NO: 504
  Synthetic Polynucleotide encoding a heavy chain variable (vH) fragment

SEQ ID NO: 8245 - DNA, 348 bp, Artificial Sequence; identical to SEQ ID NO: 505
  Synthetic Polynucleotide encoding a heavy chain variable (vH) fragment

SEQ ID NO: 8246 - DNA, 363 bp, Artificial Sequence; identical to SEQ ID NO: 506
  Synthetic Polynucleotide encoding a heavy chain variable (vH) fragment

SEQ ID NO: 8247 - DNA, 357 bp, Artificial Sequence; identical to SEQ ID NO: 507
  Synthetic Polynucleotide encoding a heavy chain variable (vH) fragment

SEQ ID NO: 8248 - DNA, 378 bp, Artificial Sequence; identical to SEQ ID NO: 508
  Synthetic Polynucleotide encoding a heavy chain variable (vH) fragment

SEQ ID NO: 8249 - DNA, 357 bp, Artificial Sequence; identical to SEQ ID NO: 509
  Synthetic Polynucleotide encoding a heavy chain variable (vH) fragment

SEQ ID NO: 8250 - DNA, 351 bp, Artificial Sequence; identical to SEQ ID NO: 510
  Synthetic Polynucleotide encoding a heavy chain variable (vH) fragment

SEQ ID NO: 8251 - DNA, 366 bp, Artificial Sequence; identical to SEQ ID NO: 511
  Synthetic Polynucleotide encoding a heavy chain variable (vH) fragment

SEQ ID NO: 8252 - DNA, 363 bp, Artificial Sequence; identical to SEQ ID NO: 512
  Synthetic Polynucleotide encoding a heavy chain variable (vH) fragment

SEQ ID NO: 8253 - DNA, 357 bp, Artificial Sequence; identical to SEQ ID NO: 513
  Synthetic Polynucleotide encoding a heavy chain variable (vH) fragment

SEQ ID NO: 8254 - DNA, 369 bp, Artificial Sequence; identical to SEQ ID NO: 514
  Synthetic Polynucleotide encoding a heavy chain variable (vH) fragment

SEQ ID NO: 8255 - DNA, 369 bp, Artificial Sequence; identical to SEQ ID NO: 515
  Synthetic Polynucleotide encoding a heavy chain variable (vH) fragment

SEQ ID NO: 8256 - DNA, 363 bp, Artificial Sequence; identical to SEQ ID NO: 516
  Synthetic Polynucleotide encoding a heavy chain variable (vH) fragment

SEQ ID NO: 8257 - DNA, 354 bp, Artificial Sequence; identical to SEQ ID NO: 517
  Synthetic Polynucleotide encoding a heavy chain variable (vH) fragment

SEQ ID NO: 8258 - DNA, 357 bp, Artificial Sequence; identical to SEQ ID NO: 518
  Synthetic Polynucleotide encoding a heavy chain variable (vH) fragment

SEQ ID NO: 8259 - DNA, 363 bp, Artificial Sequence; identical to SEQ ID NO: 519
  Synthetic Polynucleotide encoding a heavy chain variable (vH) fragment

SEQ ID NO: 8260 - DNA, 363 bp, Artificial Sequence; identical to SEQ ID NO: 520
  Synthetic Polynucleotide encoding a heavy chain variable (vH) fragment

SEQ ID NO: 8261 - DNA, 360 bp, Artificial Sequence; identical to SEQ ID NO: 521
  Synthetic Polynucleotide encoding a heavy chain variable (vH) fragment

SEQ ID NO: 8262 - DNA, 354 bp, Artificial Sequence; identical to SEQ ID NO: 309
  Synthetic Polynucleotide encoding a heavy chain variable (vH) fragment

SEQ ID NO: 8263 - DNA, 357 bp, Artificial Sequence; identical to SEQ ID NO: 522
  Synthetic Polynucleotide encoding a heavy chain variable (vH) fragment

SEQ ID NO: 8264 - DNA, 354 bp, Artificial Sequence; identical to SEQ ID NO: 523
  Synthetic Polynucleotide encoding a heavy chain variable (vH) fragment

SEQ ID NO: 8265 - DNA, 363 bp, Artificial Sequence; identical to SEQ ID NO: 524
  Synthetic Polynucleotide encoding a heavy chain variable (vH) fragment

SEQ ID NO: 8266 - DNA, 339 bp, Artificial Sequence; identical to SEQ ID NO: 525
  Synthetic Polynucleotide encoding a heavy chain variable (vH) fragment

SEQ ID NO: 8267 - DNA, 348 bp, Artificial Sequence; identical to SEQ ID NO: 526
  Synthetic Polynucleotide encoding a heavy chain variable (vH) fragment

SEQ ID NO: 8268 - DNA, 363 bp, Artificial Sequence; identical to SEQ ID NO: 527
  Synthetic Polynucleotide encoding a heavy chain variable (vH) fragment

SEQ ID NO: 8269 - DNA, 363 bp, Artificial Sequence; identical to SEQ ID NO: 528
  Synthetic Polynucleotide encoding a heavy chain variable (vH) fragment

SEQ ID NO: 8270 - DNA, 354 bp, Artificial Sequence; identical to SEQ ID NO: 529
  Synthetic Polynucleotide encoding a heavy chain variable (vH) fragment

SEQ ID NO: 8271 - DNA, 357 bp, Artificial Sequence; identical to SEQ ID NO: 530
  Synthetic Polynucleotide encoding a heavy chain variable (vH) fragment

SEQ ID NO: 8272 - DNA, 360 bp, Artificial Sequence; identical to SEQ ID NO: 531
  Synthetic Polynucleotide encoding a heavy chain variable (vH) fragment

SEQ ID NO: 8273 - DNA, 372 bp, Artificial Sequence; identical to SEQ ID NO: 532
  Synthetic Polynucleotide encoding a heavy chain variable (vH) fragment

SEQ ID NO: 8274 - DNA, 351 bp, Artificial Sequence; identical to SEQ ID NO: 294
  Synthetic Polynucleotide encoding a heavy chain variable (vH) fragment

SEQ ID NO: 8275 - DNA, 372 bp, Artificial Sequence; identical to SEQ ID NO: 295
  Synthetic Polynucleotide encoding a heavy chain variable (vH) fragment

SEQ ID NO: 8276 - DNA, 378 bp, Artificial Sequence; identical to SEQ ID NO: 296
  Synthetic Polynucleotide encoding a heavy chain variable (vH) fragment

SEQ ID NO: 8277 - DNA, 375 bp, Artificial Sequence; identical to SEQ ID NO: 304
  Synthetic Polynucleotide encoding a heavy chain variable (vH) fragment

SEQ ID NO: 8278 - DNA, 351 bp, Artificial Sequence; identical to SEQ ID NO: 305
  Synthetic Polynucleotide encoding a heavy chain variable (vH) fragment

SEQ ID NO: 8279 - DNA, 351 bp, Artificial Sequence; identical to SEQ ID NO: 306
  Synthetic Polynucleotide encoding a heavy chain variable (vH) fragment

SEQ ID NO: 8280 - DNA, 360 bp, Artificial Sequence; identical to SEQ ID NO: 310
  Synthetic Polynucleotide encoding a heavy chain variable (vH) fragment

SEQ ID NO: 8281 - DNA, 360 bp, Artificial Sequence; identical to SEQ ID NO: 311
  Synthetic Polynucleotide encoding a heavy chain variable (vH) fragment

SEQ ID NO: 8282 - DNA, 354 bp, Artificial Sequence; identical to SEQ ID NO: 312
  Synthetic Polynucleotide encoding a heavy chain variable (vH) fragment

SEQ ID NO: 8283 - DNA, 354 bp, Artificial Sequence; identical to SEQ ID NO: 313
  Synthetic Polynucleotide encoding a heavy chain variable (vH) fragment

SEQ ID NO: 8284 - DNA, 357 bp, Artificial Sequence; identical to SEQ ID NO: 314
  Synthetic Polynucleotide encoding a heavy chain variable (vH) fragment

SEQ ID NO: 8285 - DNA, 357 bp, Artificial Sequence; identical to SEQ ID NO: 315
  Synthetic Polynucleotide encoding a heavy chain variable (vH) fragment

SEQ ID NO: 8286 - DNA, 345 bp, Artificial Sequence; identical to SEQ ID NO: 316
  Synthetic Polynucleotide encoding a heavy chain variable (vH) fragment

SEQ ID NO: 8287 - DNA, 357 bp, Artificial Sequence; identical to SEQ ID NO: 317
  Synthetic Polynucleotide encoding a heavy chain variable (vH) fragment

SEQ ID NO: 8288 - DNA, 357 bp, Artificial Sequence; identical to SEQ ID NO: 318
  Synthetic Polynucleotide encoding a heavy chain variable (vH) fragment

SEQ ID NO: 8289 - DNA, 363 bp, Artificial Sequence; identical to SEQ ID NO: 319
  Synthetic Polynucleotide encoding a heavy chain variable (vH) fragment

SEQ ID NO: 8290 - DNA, 375 bp, Artificial Sequence; identical to SEQ ID NO: 320
  Synthetic Polynucleotide encoding a heavy chain variable (vH) fragment

SEQ ID NO: 8291 - DNA, 363 bp, Artificial Sequence; identical to SEQ ID NO: 330
  Synthetic Polynucleotide encoding a heavy chain variable (vH) fragment

SEQ ID NO: 8292 - DNA, 363 bp, Artificial Sequence; identical to SEQ ID NO: 331
  Synthetic Polynucleotide encoding a heavy chain variable (vH) fragment

SEQ ID NO: 8293 - DNA, 363 bp, Artificial Sequence; identical to SEQ ID NO: 332
  Synthetic Polynucleotide encoding a heavy chain variable (vH) fragment

SEQ ID NO: 8294 - DNA, 369 bp, Artificial Sequence; identical to SEQ ID NO: 333
  Synthetic Polynucleotide encoding a heavy chain variable (vH) fragment

SEQ ID NO: 8295 - DNA, 360 bp, Artificial Sequence; identical to SEQ ID NO: 334
  Synthetic Polynucleotide encoding a heavy chain variable (vH) fragment

SEQ ID NO: 8296 - DNA, 363 bp, Artificial Sequence; identical to SEQ ID NO: 335
  Synthetic Polynucleotide encoding a heavy chain variable (vH) fragment

SEQ ID NO: 8297 - DNA, 360 bp, Artificial Sequence; identical to SEQ ID NO: 336
  Synthetic Polynucleotide encoding a heavy chain variable (vH) fragment

SEQ ID NO: 8298 - DNA, 363 bp, Artificial Sequence; identical to SEQ ID NO: 337
  Synthetic Polynucleotide encoding a heavy chain variable (vH) fragment

SEQ ID NO: 8299 - DNA, 372 bp, Artificial Sequence; identical to SEQ ID NO: 338
  Synthetic Polynucleotide encoding a heavy chain variable (vH) fragment

SEQ ID NO: 8300 - DNA, 366 bp, Artificial Sequence; identical to SEQ ID NO: 341
  Synthetic Polynucleotide encoding a heavy chain variable (vH) fragment

SEQ ID NO: 8301 - DNA, 375 bp, Artificial Sequence; identical to SEQ ID NO: 342
  Synthetic Polynucleotide encoding a heavy chain variable (vH) fragment

SEQ ID NO: 8302 - DNA, 369 bp, Artificial Sequence; identical to SEQ ID NO: 343
  Synthetic Polynucleotide encoding a heavy chain variable (vH) fragment

SEQ ID NO: 8303 - DNA, 363 bp, Artificial Sequence; identical to SEQ ID NO: 345
  Synthetic Polynucleotide encoding a heavy chain variable (vH) fragment

SEQ ID NO: 8304 - DNA, 384 bp, Artificial Sequence; identical to SEQ ID NO: 346
  Synthetic Polynucleotide encoding a heavy chain variable (vH) fragment

SEQ ID NO: 8305 - DNA, 360 bp, Artificial Sequence; identical to SEQ ID NO: 347
  Synthetic Polynucleotide encoding a heavy chain variable (vH) fragment

SEQ ID NO: 8306 - DNA, 366 bp, Artificial Sequence; identical to SEQ ID NO: 344
  Synthetic Polynucleotide encoding a heavy chain variable (vH) fragment

SEQ ID NO: 8307 - DNA, 366 bp, Artificial Sequence; identical to SEQ ID NO: 349
  Synthetic Polynucleotide encoding a heavy chain variable (vH) fragment

SEQ ID NO: 8308 - DNA, 366 bp, Artificial Sequence; identical to SEQ ID NO: 350
  Synthetic Polynucleotide encoding a heavy chain variable (vH) fragment

SEQ ID NO: 8309 - DNA, 363 bp, Artificial Sequence; identical to SEQ ID NO: 351
  Synthetic Polynucleotide encoding a heavy chain variable (vH) fragment

SEQ ID NO: 8310 - DNA, 357 bp, Artificial Sequence; identical to SEQ ID NO: 363
  Synthetic Polynucleotide encoding a heavy chain variable (vH) fragment

SEQ ID NO: 8311 - DNA, 366 bp, Artificial Sequence; identical to SEQ ID NO: 364
  Synthetic Polynucleotide encoding a heavy chain variable (vH) fragment

SEQ ID NO: 8312 - DNA, 351 bp, Artificial Sequence; identical to SEQ ID NO: 365
  Synthetic Polynucleotide encoding a heavy chain variable (vH) fragment

SEQ ID NO: 8313 - DNA, 351 bp, Artificial Sequence; identical to SEQ ID NO: 366
  Synthetic Polynucleotide encoding a heavy chain variable (vH) fragment

SEQ ID NO: 8314 - DNA, 351 bp, Artificial Sequence; identical to SEQ ID NO: 367
  Synthetic Polynucleotide encoding a heavy chain variable (vH) fragment

SEQ ID NO: 8315 - DNA, 351 bp, Artificial Sequence; identical to SEQ ID NO: 368
  Synthetic Polynucleotide encoding a heavy chain variable (vH) fragment

SEQ ID NO: 8316 - DNA, 354 bp, Artificial Sequence; identical to SEQ ID NO: 369
  Synthetic Polynucleotide encoding a heavy chain variable (vH) fragment

SEQ ID NO: 8317 - DNA, 342 bp, Artificial Sequence; identical to SEQ ID NO: 377
  Synthetic Polynucleotide encoding a heavy chain variable (vH) fragment

SEQ ID NO: 8318 - DNA, 363 bp, Artificial Sequence; identical to SEQ ID NO: 386
  Synthetic Polynucleotide encoding a heavy chain variable (vH) fragment

SEQ ID NO: 8319 - DNA, 366 bp, Artificial Sequence; identical to SEQ ID NO: 387
  Synthetic Polynucleotide encoding a heavy chain variable (vH) fragment

SEQ ID NO: 8320 - DNA, 369 bp, Artificial Sequence; identical to SEQ ID NO: 388
  Synthetic Polynucleotide encoding a heavy chain variable (vH) fragment

SEQ ID NO: 8321 - DNA, 369 bp, Artificial Sequence; identical to SEQ ID NO: 389
  Synthetic Polynucleotide encoding a heavy chain variable (vH) fragment

SEQ ID NO: 8322 - DNA, 360 bp, Artificial Sequence; identical to SEQ ID NO: 394
  Synthetic Polynucleotide encoding a heavy chain variable (vH) fragment

SEQ ID NO: 8323 - DNA, 351 bp, Artificial Sequence; identical to SEQ ID NO: 395
  Synthetic Polynucleotide encoding a heavy chain variable (vH) fragment

SEQ ID NO: 8324 - DNA, 351 bp, Artificial Sequence; identical to SEQ ID NO: 396
  Synthetic Polynucleotide encoding a heavy chain variable (vH) fragment

SEQ ID NO: 8325 - DNA, 351 bp, Artificial Sequence; identical to SEQ ID NO: 397
  Synthetic Polynucleotide encoding a heavy chain variable (vH) fragment

SEQ ID NO: 8326 - DNA, 363 bp, Artificial Sequence; identical to SEQ ID NO: 398
  Synthetic Polynucleotide encoding a heavy chain variable (vH) fragment

SEQ ID NO: 8327 - DNA, 360 bp, Artificial Sequence; identical to SEQ ID NO: 399
  Synthetic Polynucleotide encoding a heavy chain variable (vH) fragment

SEQ ID NO: 8328 - DNA, 354 bp, Artificial Sequence; identical to SEQ ID NO: 412
  Synthetic Polynucleotide encoding a heavy chain variable (vH) fragment

SEQ ID NO: 8329 - DNA, 378 bp, Artificial Sequence; identical to SEQ ID NO: 413
  Synthetic Polynucleotide encoding a heavy chain variable (vH) fragment

SEQ ID NO: 8330 - DNA, 342 bp, Artificial Sequence; identical to SEQ ID NO: 431
  Synthetic Polynucleotide encoding a heavy chain variable (vH) fragment

SEQ ID NO: 8331 - DNA, 354 bp, Artificial Sequence; identical to SEQ ID NO: 432
  Synthetic Polynucleotide encoding a heavy chain variable (vH) fragment

SEQ ID NO: 8332 - DNA, 369 bp, Artificial Sequence; identical to SEQ ID NO: 439
  Synthetic Polynucleotide encoding a heavy chain variable (vH) fragment

SEQ ID NO: 8333 - DNA, 366 bp, Artificial Sequence; identical to SEQ ID NO: 441
  Synthetic Polynucleotide encoding a heavy chain variable (vH) fragment

SEQ ID NO: 8334 - DNA, 366 bp, Artificial Sequence; identical to SEQ ID NO: 442
  Synthetic Polynucleotide encoding a heavy chain variable (vH) fragment

SEQ ID NO: 8335 - DNA, 354 bp, Artificial Sequence; identical to SEQ ID NO: 500
  Synthetic Polynucleotide encoding a heavy chain variable (vH) fragment

SEQ ID NO: 8336 - DNA, 348 bp, Artificial Sequence; identical to SEQ ID NO: 533
  Synthetic Polynucleotide encoding a heavy chain variable (vH) fragment

SEQ ID NO: 8337 - DNA, 342 bp, Artificial Sequence; identical to SEQ ID NO: 534
  Synthetic Polynucleotide encoding a heavy chain variable (vH) fragment

SEQ ID NO: 8338 - DNA, 378 bp, Artificial Sequence; identical to SEQ ID NO: 535
  Synthetic Polynucleotide encoding a heavy chain variable (vH) fragment

SEQ ID NO: 8339 - DNA, 336 bp, Artificial Sequence; identical to SEQ ID NO: 536
  Synthetic Polynucleotide encoding a heavy chain variable (vH) fragment

SEQ ID NO: 8340 - DNA, 390 bp, Artificial Sequence; identical to SEQ ID NO: 537
  Synthetic Polynucleotide encoding a heavy chain variable (vH) fragment

SEQ ID NO: 8341 - DNA, 351 bp, Artificial Sequence; identical to SEQ ID NO: 538
  Synthetic Polynucleotide encoding a heavy chain variable (vH) fragment

SEQ ID NO: 8342 - DNA, 357 bp, Artificial Sequence; identical to SEQ ID NO: 539
  Synthetic Polynucleotide encoding a heavy chain variable (vH) fragment

SEQ ID NO: 8343 - DNA, 351 bp, Artificial Sequence; identical to SEQ ID NO: 540
  Synthetic Polynucleotide encoding a heavy chain variable (vH) fragment

SEQ ID NO: 8344 - DNA, 354 bp, Artificial Sequence; identical to SEQ ID NO: 541
  Synthetic Polynucleotide encoding a heavy chain variable (vH) fragment

SEQ ID NO: 8345 - DNA, 366 bp, Artificial Sequence; identical to SEQ ID NO: 542
  Synthetic Polynucleotide encoding a heavy chain variable (vH) fragment

SEQ ID NO: 8346 - DNA, 363 bp, Artificial Sequence; identical to SEQ ID NO: 543
  Synthetic Polynucleotide encoding a heavy chain variable (vH) fragment

SEQ ID NO: 8347 - DNA, 351 bp, Artificial Sequence; identical to SEQ ID NO: 544
  Synthetic Polynucleotide encoding a heavy chain variable (vH) fragment

SEQ ID NO: 8348 - DNA, 360 bp, Artificial Sequence; identical to SEQ ID NO: 545
  Synthetic Polynucleotide encoding a heavy chain variable (vH) fragment

SEQ ID NO: 8349 - DNA, 360 bp, Artificial Sequence; identical to SEQ ID NO: 546
  Synthetic Polynucleotide encoding a heavy chain variable (vH) fragment

SEQ ID NO: 8350 - DNA, 351 bp, Artificial Sequence; identical to SEQ ID NO: 547
  Synthetic Polynucleotide encoding a heavy chain variable (vH) fragment

SEQ ID NO: 8351 - DNA, 351 bp, Artificial Sequence; identical to SEQ ID NO: 548
  Synthetic Polynucleotide encoding a heavy chain variable (vH) fragment

SEQ ID NO: 8352 - DNA, 354 bp, Artificial Sequence; identical to SEQ ID NO: 549
  Synthetic Polynucleotide encoding a heavy chain variable (vH) fragment

SEQ ID NO: 8353 - DNA, 357 bp, Artificial Sequence; identical to SEQ ID NO: 550
  Synthetic Polynucleotide encoding a heavy chain variable (vH) fragment

SEQ ID NO: 8354 - DNA, 372 bp, Artificial Sequence; identical to SEQ ID NO: 551
  Synthetic Polynucleotide encoding a heavy chain variable (vH) fragment

SEQ ID NO: 8355 - DNA, 381 bp, Artificial Sequence; identical to SEQ ID NO: 552
  Synthetic Polynucleotide encoding a heavy chain variable (vH) fragment

SEQ ID NO: 8356 - DNA, 366 bp, Artificial Sequence; identical to SEQ ID NO: 553
  Synthetic Polynucleotide encoding a heavy chain variable (vH) fragment

SEQ ID NO: 8357 - DNA, 381 bp, Artificial Sequence; identical to SEQ ID NO: 554
  Synthetic Polynucleotide encoding a heavy chain variable (vH) fragment

SEQ ID NO: 8358 - DNA, 381 bp, Artificial Sequence; identical to SEQ ID NO: 272
  Synthetic Polynucleotide encoding a heavy chain variable (vH) fragment

SEQ ID NO: 8359 - DNA, 360 bp, Artificial Sequence; identical to SEQ ID NO: 556
  Synthetic Polynucleotide encoding a heavy chain variable (vH) fragment

SEQ ID NO: 8360 - DNA, 360 bp, Artificial Sequence; identical to SEQ ID NO: 557
  Synthetic Polynucleotide encoding a heavy chain variable (vH) fragment

SEQ ID NO: 8361 - DNA, 354 bp, Artificial Sequence; identical to SEQ ID NO: 558
  Synthetic Polynucleotide encoding a heavy chain variable (vH) fragment

SEQ ID NO: 8362 - DNA, 366 bp, Artificial Sequence; identical to SEQ ID NO: 559
  Synthetic Polynucleotide encoding a heavy chain variable (vH) fragment

SEQ ID NO: 8363 - DNA, 360 bp, Artificial Sequence; identical to SEQ ID NO: 560
  Synthetic Polynucleotide encoding a heavy chain variable (vH) fragment

SEQ ID NO: 8364 - DNA, 348 bp, Artificial Sequence
  Synthetic Polynucleotide encoding a heavy chain variable (vH) fragment
gaagtgcagctggttcagtctggggccgaagtgaagaagcctggcgagagcctgaagatcagctgcaaaggcagcggctacagcttcaccggctacaacatgaactgggtccgacagatgcccggcaaaggactggaatggatgggcaacatcgacccctactacggcggcaccacctacaaccggaagttcaagggccaagtgaccatcagcgccgacaagagcatcagcacagcctacctccagtggtcctctctgaaggccagcgacaccgccatgtactactgtgccagaagcgtgggacccttcgattcttggggccagggaacactggtcaccgtttctagc

SEQ ID NO: 8365 - DNA, 348 bp, Artificial Sequence
  Synthetic Polynucleotide encoding a heavy chain variable (vH) fragment
gctgttcagcttgttcagtctggggccgaagtgaagaaacccggcagctctgtgaaggtgtcctgcaaggccagcggctacagcttcaccggctacaacatgaactgggtccgacaagccccaggacagggccttgagtggatgggcaatatcgacccttactacggcggcaccacctacaaccggaagttcaagggcagagtgacactgaccgtggacaagagcagcagcaccgcctacatggaactgtccagcctgagaagcgaggacaccgccgtgtactactgcgctagaagcgtgggacctatggactattggggccagggcacactggtcaccgttagctct

SEQ ID NO: 8366 - DNA, 360 bp, Artificial Sequence
  Synthetic Polynucleotide encoding a heavy chain variable (vH) fragment
gaagttcagctgcttgaaagtggtggcggcctggttcaacctggcggatctctgagactgagctgtgccgccagcggcttcacctttagcagctacgccatgagctgggtccgacaggctcctggcaaatgcctggaatgggtgtccgtgattagcggctctggcggcagacctaattacgccgagtctgtgaagggcagattcaccatcagccgggacaacagcaagaacaccctgtacctccagatgaacagcctgcgcgacgaggacacagccgtgtattattgcgccaaggtggactacagcaactacctgttcttcgactactggggccagggcaccctggtcacagtttcttct

SEQ ID NO: 8367 - DNA, 360 bp, Artificial Sequence
  Synthetic Polynucleotide encoding a heavy chain variable (vH) fragment
gaggttcagctgctggaatctggcggaggaatggttcagcctggcggctctctgagactgtcttgtgccgccagcggcttcacctttagcagctacgccatgagctgggtccgacaggcccctggaaaatgcctggaatgggtgtccgccatctctggctctggcggcagaaccttttacgccgagtctgtggaaggccggttcaccatcagccgggacaacagcaagaacaccctgtacctccagatgaacagcctgagagccgaggacaccgccgtgtactattgcgccaagcacgactacagcaactacccctacttcgactactggggccagggcacactggtcacagtttctagc

SEQ ID NO: 8368 - DNA, 360 bp, Artificial Sequence
  Synthetic Polynucleotide encoding a heavy chain variable (vH) fragment
gaggttcagctgctggaatctggcggaggaatggttcagcctggcggctctctgagactgtcttgtgccgccagcggcttcacctttagcacctacgccatgagctgggtccgacaggcccctggaaaatgcctggaatgggtgtccgccatctctggctctggcggcagaaccttttacgccgagtctgtggaaggccggttcaccatcagccgggacaacagcaagaacaccctgtacctccagatgaacagcctgagagccgaggacaccgccgtgtactattgcgccaagcacgactacagcaactacccctacttcgactactggggccagggcacactggtcacagtttctagc

SEQ ID NO: 8369 - DNA, 360 bp, Artificial Sequence
  Synthetic Polynucleotide encoding a heavy chain variable (vH) fragment
gaagttcagctgcttgaatctggcggcggactggttcaacctggcggatctctgagactgtcttgtgccgccagcggcttcaccttcagcagctatgccatgagctgggtccgacaggcccctggcaaatgtctggaatgggtgtccgccatctctggctctggcggctctaccttttacgccgagtctgtgcagggcagattcaccatctccagagacaacagcaagaacaccctgtacctgcaagtgaacagcctgagagccgaggacacagccgtgtattattgcgccagacacgactacagcaactacccctacttcgactactggggccagggcaccctggtcacagtttcttct

SEQ ID NO: 8370 - DNA, 354 bp, Artificial Sequence
  Synthetic Polynucleotide encoding a heavy chain variable (vH) fragment
caagttcagctgcttgaatccggtggcggcgttgtgcaacctggcagaagtctgagactgagctgtgccgccagcggcttcaccttcagcagctacatcatgcactgggtccgacaggcccctggcaaaggacttgaatgggtcgccgtgatctcctacgacggcagaaacaagtattacgccgacagcgtgaagggcagattcaccatctccagagacaacagcaagaacaccctgtacctccagatgaacagcctgagagccgaggacacagccgtgtattattgcgccaaggacaccgacggctacgacttcgattattggggccagggcacaatggtcaccgtgtctagt

SEQ ID NO: 8371 - DNA, 366 bp, Artificial Sequence
  Synthetic Polynucleotide encoding a heavy chain variable (vH) fragment
caggttcagctgcaagagtctggccctggcctggtcaagcctagcgaaacactgagcctgacctgtaccgttagcggcggctctgtgtccagcgactactactactggtcctggatcagacagcctcctggcaaaggactggaatggctgggctacatctactacagcggcagcaccaactacaaccccagcctgaagtccagagtgaccatcagcgtggacaccagcaagaaccagttctccctgaagctgcggagcgtgaccacagccgatacagccgtgtactactgtgctagaggcgacggcgattacggcggcaactgctttgattattggggccagggcaccctggtcaccgtttctagc

SEQ ID NO: 8372 - DNA, 357 bp, Artificial Sequence
  Synthetic Polynucleotide encoding a heavy chain variable (vH) fragment
caaattcagctggttgaatctggcggcggagtggtgcaacctggcagaagtctgagactgagctgtgccgccagcggcttcacctttggctactatgccatgcactgggtccgacaggcccctggcaaaggacttgaatgggtcgccgtgatctcctacgacggctccatcaagtattacgccgacagcgtgaagggcagattcaccatcagccgggacaacagcaagaacaccctgtacctccagatgaacagcctgagagccgaggacaccgccgtgtactactgtgccagagagggaccctacagcaactacctggattactggggccagggcaccctggtcacagtctcttct

SEQ ID NO: 8373 - DNA, 360 bp, Artificial Sequence
  Synthetic Polynucleotide encoding a heavy chain variable (vH) fragment
gaagttcagctgcttgaatctggcggcggactggctcaacctggcggatctctgagactgtcttgtgccgccagcggcttcacctttagcagctacgccatgagctgggtccgacaggcccctggaaaatgcctggaatgggtgtccgccatctctggctctggcggctctaccttttacgccgagtctgtgaagggcagattcaccatcagccgggacaacagcaagaacaccctgtacctccagatgaacagcctgagagccgaggataccgccgtgtatttctgcgccaagcacgactacagcaactacccctacttcgactactggggccagggcaccctggtcacagtttcttct

SEQ ID NO: 8374 - DNA, 360 bp, Artificial Sequence
  Synthetic Polynucleotide encoding a heavy chain variable (vH) fragment
gaagttcagctgcttgaatccggcggaggcatggttcaacctggcggatctctgagactgtcctgtgccgccagcggcttcacctttagcagctacgccatgagctgggtccgacaggcacctggcaaaggactggaatgggtgtccgccatctctggctctggcggcagaaccttttacgccgagtctgtggaaggccggttcaccatcagccgggacaacagcaagaacaccctgtacctccagatgaacagcctgagagccgaggacacagccgtgtattattgcgccaagcacgactacagcaactacccctacttcgactactggggccagggcaccctggtcacagtttcttct

SEQ ID NO: 8375 - DNA, 387 bp, Artificial Sequence
  Synthetic Polynucleotide encoding a heavy chain variable (vH) fragment
gctggactgatgcagtctggcgctgtgatgaagaacagcggagccagcgtcagagtgtcctgtcaggccgatggctacgatttcatcgactacgtgatccactggttccggcagcggagaggcgaaggacttgaatggctcggctggatgaatccttctggcggcggaacaaactaccccagacctttccagggcaaagtgaccatgaccagagacaccagcaccgagacagcctacctggatgttcggggcctgacctacgatgacaccgccgtgtattactgcgtgcgggacagagccaatggcagtggcaggcggagattcgagagcgtgaactggttcctggacctgtggggcagaggcacccagatcacagtggtttctgct

SEQ ID NO: 8376 - DNA, 384 bp, Artificial Sequence
  Synthetic Polynucleotide encoding a heavy chain variable (vH) fragment
gctgatcttgttcagtctggcgctgtggtcaagaaacccggcgatagcgtgcggatctcttgcgaggctcagggctacagattccccgactacatcatccactggattcggagagccccaggccagggacctgaatggatgggctggatgaatcctatgggcggccaagtgaacatcccctggaagtttcagggcagagtgtccatgaccagagacacctctatcgagactgccttcctggacctgaggggcctgaagtctgatgacaccgccgtgtactactgcgtgcgggacagaagcaatggcagcggcaagagattcgagagcagcaactggttcctggatctgtggggaagaggcaccgctgtgacaatccagtctgct

SEQ ID NO: 8377 - DNA, 387 bp, Artificial Sequence
  Synthetic Polynucleotide encoding a heavy chain variable (vH) fragment
tctgctgaactggttcagtctggggccgtcgtgaagaaacctggcacctctgtgaaggtgtcctgccaggcttacggctacacctttaccgactacctgatccactggctgagacaggcccctggacaaggactggaatggatgggctggatgaaccccgtgtacggccaagtgaactacgcccagaacttccagggcagagtgtccatgaccagagacatctacagagagacagccttcctggaagtgcgggacctgaaaaccgatgacaccggcacctactactgcgtcagagatacaggcgacggcagcagaaggcacttcgacagcatcaactggtttctggacctgtggggcagaggcacctggattagagttgctcctgct

SEQ ID NO: 8378 - DNA, 360 bp, Artificial Sequence
  Synthetic Polynucleotide encoding a heavy chain variable (vH) fragment
caaattgagctggtgcagagcggcacagaagtgaagaggccaggcgcttctgtgcggatcagctgtgcctctagcggctacagattcaccaactacttcatccactgggtccgacaggcccctggcagaggacttgaatggatgggctggatgaaccctctgcacggcggcgtgaactacagcggcagatttcagggcagagtgaccatgaccagagacatctacaccgaaaccagcttcatggtgctgtccggcctgacctccgacgacaccgccatctatttctgtaccagaggccgcgacggctacgacgatggatttcatccttggggccagggaaccctggtcacagtttctgct

SEQ ID NO: 8379 - DNA, 360 bp, Artificial Sequence; identical to SEQ ID NO: 8378
  Synthetic Polynucleotide encoding a heavy chain variable (vH) fragment

SEQ ID NO: 8380 - DNA, 363 bp, Artificial Sequence
  Synthetic Polynucleotide encoding a heavy chain variable (vH) fragment
cacgtccaattggtgcagtctggaggtggggtgaagaagattggggccgctgtgaggatctcctgcgaggtgactggatataaattcatggaccaactcataaactgggtgcggcaggcccccggtcagggccttgagtggatgggatggatgaatccaacatatggacaagtaaattattcatggagatttgaaggaagggtcaccatgaccagggacatggacaccgagacggccttcatggagttgagaggactgagagtggacgacacggccgtctattattgcgcgaggggaccctctggggaaaattatccttttcactattggggccagggtgtccgagtggtcgtctcgtcaccc

SEQ ID NO: 8381 - DNA, 360 bp, Artificial Sequence
  Synthetic Polynucleotide encoding a heavy chain variable (vH) fragment
cgggcgcagctggtgcagtctgggcctgaggtgaagaagcctggggcctcagtgaggatctcctgcgcggcttctggatacaccttcgtcgattcctttatccactggctgcgacaggcccctggacaagggcttgagtggataggatggatcaaccctctccgtggtggcgtaaactattcaggcaggtttcagggcagggtcgccatgaccaggaacacgttcaccgagacagtctacatggacatcaacgggctgacacctgacgacacggccacgtatttctgtgtgagagcccccgattcgtacgacagagggtacgacgcctggggccaaggaacccgggtcatcgtcacctca

SEQ ID NO: 8382 - DNA, 360 bp, Artificial Sequence
  Synthetic Polynucleotide encoding a heavy chain variable (vH) fragment
cgggtgcagctggtgcagtctgggcctgaggtgaagaagcctggggcctcagtgaggatctcctgcaaggcttctggatacaagttctccgactcccttatccactggctgcgacagtcccctcgagacgggcttcagtggctaggatacatgaaccctatgggtggtgccgtaaactatgcacacaggcttcagggcagggtccagatgaccagggacatcttctccgagacagcctacatggatatccgcgggctgacacctgacgacacggccacgtatttctgtgtgagagaccccgacgcatatgagcgcgggttcgacgcctggggccaaggaacccggatcgtcgtcacctca

SEQ ID NO: 8383 - DNA, 390 bp, Artificial Sequence
  Synthetic Polynucleotide encoding a heavy chain variable (vH) fragment
caggtgcagctgcaggagtcgggcccaggactggtgaagccttcacagaccgtgtccctcacctgcagtgtctctggtggctccatcagcagtggtggttaccactggagctggatccgccagcacccagggaagggcctggagtggattgggtacatctatcacaatgggaacacctactacaacccgtccctcgagagtcgagttaccatatcagtagacacgtctaagaaccagttctccctgaagctgacctctgtgactgccgcggacacggccgtgtattactgtgcgagaaatagtgctagggctggaagccacctgctactcggaagggataagtcctggttcgacccctggggccaaggaaccctggtcatcgtctcctca

SEQ ID NO: 8384 - DNA, 390 bp, Artificial Sequence
  Synthetic Polynucleotide encoding a heavy chain variable (vH) fragment
caggtgcagctgcaggagtcgggcccaggactggtgaagccttcacagaccgtgtccctcacctgcagtgtctctggtggctccatcagcagtggtggttaccactggagctggatccgccagcacccagggaagggcctggagtggattgggtacatctattacaatgggaacacctactacaacccgtccctcgagagtcgagttaccatatcagtagacacgtctaagaaccagttctccctgaagctgacctctgtgactgccgcggacacggccgtgtattactgtgcgagaaatagtgctagggctggaagccacctgctactcggaagggataagtcctggttcgacccctggggccaaggaaccctggtcatcgtctcctca

SEQ ID NO: 8385 - DNA, 354 bp, Artificial Sequence
  Synthetic Polynucleotide encoding a heavy chain variable (vH) fragment
cagctgcagctggtgcagtctggggctgaggtgaagaagcctggggcctcagtgaaggtctcctgcaaggcttctggagactccgtcaccggctactatatccactgggtgcgacaggcccctggacaagggcttgagtggataggatggatccgccctaacaatggtggcacaaactttccacggaagtttcagggcagggtcaccatgacctgggacacgtccctcaccacagcctacatggacctgagcgggctgacatctgacgacacggccgtgtattactgtgtgccacacaggtggccagactactttgactcctggggccaaggaaccctggtcatcgtctcctca

SEQ ID NO: 8386 - DNA, 399 bp, Artificial Sequence
  Synthetic Polynucleotide encoding a heavy chain variable (vH) fragment
ctggtgcatctggtgcagtctggggctgaggtgaagaagcctgggtcctcggtgaaggtctcctgcaaggcttctggaggcaccttcagcagccatgttatcaactgggtgcgacaggcccctggacaagggcttgagtggatgggagggatcatgcctctccttggtacagcaaactacccacagaagttccagggcagagtcacgattatcgcggacgaatccacgaacacagcctacatggagctgagcagcctgagatctgaggacacggccgtgtatttctgtgcgacaagtagtgaggccgacgactacagtactgggttcgagatgggagaatactactacgactactatgtggacgtctgggggacagggaccacggtcaccgtctcctca

SEQ ID NO: 8387 - DNA, 393 bp, Artificial Sequence
  Synthetic Polynucleotide encoding a heavy chain variable (vH) fragment
caggtgcagctggtgcagtctggggctgaggtgaagaagcctgggtcctcggtgaagctctcctgcaaggcttctggaggcaccttctacagctattctctcaactgggtgcgacaggcccctggacaagggcttgagtggatgggagggatcatccctttctttggttcagcaaactacgcacagaagttccagggcagagtcacgattaccgcggacgaatccacgaccacagcctacctggagctgagcaccctgagacctgatgacacggccgtgtattactgtgcgggacggggtgagactaatgactacggtgacggtggtgagttcggctactactactcctatctggacgactggggcaaagggaccacggtcaccgtctgctta

SEQ ID NO: 8388 - DNA, 393 bp, Artificial Sequence
  Synthetic Polynucleotide encoding a heavy chain variable (vH) fragment
caggtgcagctggtgcagtctggggctgaggtgaagaagcctgggtcctcggtgaagctctcctgcaaggcttctggaggcaccttctacagctattctatcaactgggtgcgacaggcccctggacaagggcttgagtggatgggagggatcatccctttctttggttcagcaaactacgcacagaagttccagggcagagtcacgattaccgcggacgaatccacgaccacagcctacctggagctgagctccctgagacctgatgacacggccgtgtattactgtgcgggacggggtgagactaatgactacgctgacggtggtgagttcggctactactactcctatatggccgactggggcaaagggaccacggtcaccgtctcctca

SEQ ID NO: 8389 - DNA, 393 bp, Artificial Sequence
  Synthetic Polynucleotide encoding a heavy chain variable (vH) fragment
caggtgcagctggtgcagtctggggctgaggtgaagaagcctgggtcctcggtgaaggtctcctgcaaggcttctggaggcaccttcgaaagctattctatcaactgggtgcgacaggcccctggacaagggcttgagtggatgggagggatcatccctttctttggtgcagcaaactacgcaccgaggttccagggcagagtcacgattaccgcggacgaatccacgaccacagcctacctggaggtgaacaacctgagacctgatgacacggccgtgtattactgtgcgggacggggtgagactaatgactacggtgacgatggtcggttcggctactactactcctatatggccgactggggcaaagggaccacggtcaccgtctcctca

SEQ ID NO: 8390 - DNA, 393 bp, Artificial Sequence
  Synthetic Polynucleotide encoding a heavy chain variable (vH) fragment
caggtgcacctggtgcagtctggggctgaggtgaagaagcctgggtcctcggtgaaggtctcctgcagggcttctggaggcaccttcgacagctattctttcaactgggtgcgacaggcccctggacaagggcttgagtggatgggagggatcatccctttctttggtgcagcaaactacgcacagaatttccagggcagagtcacgattaccgcggacgaatccacgaccacagcctacctggagctgagctccctgagacctgatgacacggccgtgtattactgtgcgggacggggtgatactaatgactacggtgacgatggtcagttcggctactactactcctatatgggcgactggggcaaagggaccacggtcaccgtctcctca

SEQ ID NO: 8391 - DNA, 393 bp, Artificial Sequence
  Synthetic Polynucleotide encoding a heavy chain variable (vH) fragment
caggtccacctggtgcagtctggggctgaggtgaagaagcctagatcctcggtgagggtctcctgcgaggcttctggagggatcttcagcgacttttctttgaactgggtgcgacaggcccctggacaggggcttgagtggatgggaggaatcatccccttctttggtacagcattctacgcaccgaagttccagggcagactcaccattaccgcggacgaatccacgagcacagcctacatggacctgagcagcctgagatctgacgacacggccatgtatttctgtgcgggaagcgaaagtccgaatgagtacggtgactcgacccaatttggtttctactacaactacatggccgtctggggcaaagggaccacggtcaccgtctcctca

SEQ ID NO: 8392 - DNA, 369 bp, Artificial Sequence
  Synthetic Polynucleotide encoding a heavy chain variable (vH) fragment
gatgtgcagctggtgcagtctggagcagaggtgaaaaagcccggggagtctctgaagatctcctgtcaggcttctggatacacctttaccgacaactggatcgcctgggtgcgccagatgcccgggaaaggcctggagtgggtggggttcacctatcctgctgactctgataccagatacagcccgtccttccaaggccatgtcaccatctcagccgacaagtccatgaggaccgccttcctggagtggagcagcctgagggcctcggacaccgccatgtattactgtgcgagactgggtggtcaatgtaccgatggagtatgctactttgaccactggggccgaggaaccctggtcaccgtctcctca

SEQ ID NO: 8393 - DNA, 369 bp, Artificial Sequence
  Synthetic Polynucleotide encoding a heavy chain variable (vH) fragment
gatgtgcagctggtgcagtctggagcagaggtgaaaaagcccggggagtctctgaagatctcctgtcagggttttggatacacctttaccgacaactggatcgcctgggtgcgccagatgcccgggaaaggcctggagtgggtggggttcacctatcctgatgactctgataccagatacagcccgtccttccaaggccatgtcaccatctcagccgacaagtccatgaggaccgccttcctgcagtggagcagcctgagggcctcggacaccgccatgtattactgtgcgagactgggtggtcaatgtagcgatggagtatgctactttgaccactggggccgaggaaccctggtcaccgtctcctca

SEQ ID NO: 8394 - DNA, 354 bp, Artificial Sequence
  Synthetic Polynucleotide encoding a heavy chain variable (vH) fragment
caagtgcagctggttgaatcaggtggcggcgttgtgcagcctggcagaagtctgagactgagctgtgccgcctctggctttagcctgacaagctatggcgtgcactgggtccgacaggcccctggaaaaggactggaatgggtcgccgtgatttggagcgacggcagcaccacatacaacagcgccctgaagtcccggttcaccatcagcagagacaacagcaagaacaccctgtacctccagatgaactccctgagagccgacgacaccgccgtgtactattgcgccagacactacggctctaccctggcctttgcttcttggggccagggcacactggtcaccgtttcttct

SEQ ID NO: 8395 - DNA, 375 bp, Artificial Sequence
  Synthetic Polynucleotide encoding a heavy chain variable (vH) fragment
gaagtgcagctggttgaatcaggtggcggcctggttcaacctggcggatctctgagactgagctgtgccgccagcggcttcacctttagcaactactggatgaactgggtccgacaggcccctggcaaaggactggaatgggttgccgagatccggttcaagtcccacaactacgccacacacttcgccgagagcgtgaagggcagattcaccatctccagagacaacgccaagaacagcctgtacctccagatgaactccctgagagtggaagataccgccgtgtattattgcgtgcggcggatcggcaacagcgactacgattggtggtacttcgacgtgtggggcagaggcacactcgtgactgttagctct

SEQ ID NO: 8396 - DNA, 354 bp, Artificial Sequence
  Synthetic Polynucleotide encoding a heavy chain variable (vH) fragment
gaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttct

SEQ ID NO: 8397 - DNA, 354 bp, Artificial Sequence; identical to SEQ ID NO: 8396
  Synthetic Polynucleotide encoding a heavy chain variable (vH) fragment

SEQ ID NO: 8398 - DNA, 354 bp, Artificial Sequence; identical to SEQ ID NO: 8396
  Synthetic Polynucleotide encoding a heavy chain variable (vH) fragment

SEQ ID NO: 8399 - DNA, 354 bp, Artificial Sequence; identical to SEQ ID NO: 8396
  Synthetic Polynucleotide encoding a heavy chain variable (vH) fragment

SEQ ID NO: 8400 - DNA, 354 bp, Artificial Sequence; identical to SEQ ID NO: 8396
  Synthetic Polynucleotide encoding a heavy chain variable (vH) fragment

SEQ ID NO: 8401 - DNA, 354 bp, Artificial Sequence; identical to SEQ ID NO: 8396
  Synthetic Polynucleotide encoding a heavy chain variable (vH) fragment

SEQ ID NO: 8402 - DNA, 354 bp, Artificial Sequence; identical to SEQ ID NO: 8396
  Synthetic Polynucleotide encoding a heavy chain variable (vH) fragment

SEQ ID NO: 8403 - DNA, 366 bp, Artificial Sequence; identical to SEQ ID NO: 542
  Synthetic Polynucleotide encoding a heavy chain variable (vH) fragment

SEQ ID NO: 8404 - DNA, 726 bp, Artificial Sequence; identical to SEQ ID NO: 642
  Synthetic Polynucleotide encoding a scFv

SEQ ID NO: 8405 - DNA, 726 bp, Artificial Sequence; identical to SEQ ID NO: 643
  Synthetic Polynucleotide encoding a scFv

SEQ ID NO: 8406 - DNA, 729 bp, Artificial Sequence; identical to SEQ ID NO: 644
  Synthetic Polynucleotide encoding a scFv

SEQ ID NO: 8407 - DNA, 750 bp, Artificial Sequence; identical to SEQ ID NO: 645
  Synthetic Polynucleotide encoding a scFv

SEQ ID NO: 8408 - DNA, 747 bp, Artificial Sequence; identical to SEQ ID NO: 646
  Synthetic Polynucleotide encoding a scFv

SEQ ID NO: 8409 - DNA, 720 bp, Artificial Sequence; identical to SEQ ID NO: 659
  Synthetic Polynucleotide encoding a scFv

SEQ ID NO: 8410 - DNA, 753 bp, Artificial Sequence; identical to SEQ ID NO: 660
  Synthetic Polynucleotide encoding a scFv

SEQ ID NO: 8411 - DNA, 726 bp, Artificial Sequence; identical to SEQ ID NO: 661
  Synthetic Polynucleotide encoding a scFv

SEQ ID NO: 8412 - DNA, 750 bp, Artificial Sequence; identical to SEQ ID NO: 662
  Synthetic Polynucleotide encoding a scFv

SEQ ID NO: 8413 - DNA, 738 bp, Artificial Sequence; identical to SEQ ID NO: 663
  Synthetic Polynucleotide encoding a scFv

SEQ ID NO: 8414 - DNA, 732 bp, Artificial Sequence; identical to SEQ ID NO: 664
  Synthetic Polynucleotide encoding a scFv

SEQ ID NO: 8415 - DNA, 732 bp, Artificial Sequence; identical to SEQ ID NO: 665
  Synthetic Polynucleotide encoding a scFv

SEQ ID NO: 8416 - DNA, 735 bp, Artificial Sequence; identical to SEQ ID NO: 666
  Synthetic Polynucleotide encoding a scFv

SEQ ID NO: 8417 - DNA, 729 bp, Artificial Sequence; identical to SEQ ID NO: 667
  Synthetic Polynucleotide encoding a scFv

SEQ ID NO: 8418 - DNA, 735 bp, Artificial Sequence; identical to SEQ ID NO: 671
  Synthetic Polynucleotide encoding a scFv

SEQ ID NO: 8419 - DNA, 735 bp, Artificial Sequence; identical to SEQ ID NO: 672
  Synthetic Polynucleotide encoding a scFv

SEQ ID NO: 8420 - DNA, 735 bp, Artificial Sequence; identical to SEQ ID NO: 672
  Synthetic Polynucleotide encoding a scFv

SEQ ID NO: 8421 - DNA, 732 bp, Artificial Sequence; identical to SEQ ID NO: 674
  Synthetic Polynucleotide encoding a scFv

SEQ ID NO: 8422 - DNA, 741 bp, Artificial Sequence; identical to SEQ ID NO: 675
  Synthetic Polynucleotide encoding a scFv

SEQ ID NO: 8423 - DNA, 744 bp, Artificial Sequence; identical to SEQ ID NO: 676
  Synthetic Polynucleotide encoding a scFv

SEQ ID NO: 8424 - DNA, 720 bp, Artificial Sequence; identical to SEQ ID NO: 689
  Synthetic Polynucleotide encoding a scFv

SEQ ID NO: 8425 - DNA, 738 bp, Artificial Sequence; identical to SEQ ID NO: 690
  Synthetic Polynucleotide encoding a scFv

SEQ ID NO: 8426 - DNA, 717 bp, Artificial Sequence; identical to SEQ ID NO: 692
  Synthetic Polynucleotide encoding a scFv

SEQ ID NO: 8427 - DNA, 729 bp, Artificial Sequence; identical to SEQ ID NO: 693
  Synthetic Polynucleotide encoding a scFv

SEQ ID NO: 8428 - DNA, 723 bp, Artificial Sequence; identical to SEQ ID NO: 694
  Synthetic Polynucleotide encoding a scFv

SEQ ID NO: 8429 - DNA, 750 bp, Artificial Sequence; identical to SEQ ID NO: 695
  Synthetic Polynucleotide encoding a scFv

SEQ ID NO: 8430 - DNA, 738 bp, Artificial Sequence; identical to SEQ ID NO: 696
  Synthetic Polynucleotide encoding a scFv

SEQ ID NO: 8431 - DNA, 750 bp, Artificial Sequence; identical to SEQ ID NO: 703
  Synthetic Polynucleotide encoding a scFv

SEQ ID NO: 8432 - DNA, 708 bp, Artificial Sequence; identical to SEQ ID NO: 704
  Synthetic Polynucleotide encoding a scFv

SEQ ID NO: 8433 - DNA, 735 bp, Artificial Sequence; identical to SEQ ID NO: 705
  Synthetic Polynucleotide encoding a scFv

SEQ ID NO: 8434 - DNA, 723 bp, Artificial Sequence; identical to SEQ ID NO: 706
  Synthetic Polynucleotide encoding a scFv

SEQ ID NO: 8435 - DNA, 747 bp, Artificial Sequence; identical to SEQ ID NO: 708
  Synthetic Polynucleotide encoding a scFv

SEQ ID NO: 8436 - DNA, 732 bp, Artificial Sequence; identical to SEQ ID NO: 721
  Synthetic Polynucleotide encoding a scFv

SEQ ID NO: 8437 - DNA, 717 bp, Artificial Sequence; identical to SEQ ID NO: 722
  Synthetic Polynucleotide encoding a scFv

SEQ ID NO: 8438 - DNA, 726 bp, Artificial Sequence; identical to SEQ ID NO: 723
  Synthetic Polynucleotide encoding a scFv

SEQ ID NO: 8439 - DNA, 711 bp, Artificial Sequence; identical to SEQ ID NO: 724
  Synthetic Polynucleotide encoding a scFv

SEQ ID NO: 8440 - DNA, 741 bp, Artificial Sequence; identical to SEQ ID NO: 725
  Synthetic Polynucleotide encoding a scFv

SEQ ID NO: 8441 - DNA, 717 bp, Artificial Sequence; identical to SEQ ID NO: 726
  Synthetic Polynucleotide encoding a scFv

SEQ ID NO: 8442 - DNA, 726 bp, Artificial Sequence; identical to SEQ ID NO: 727
  Synthetic Polynucleotide encoding a scFv

SEQ ID NO: 8443 - DNA, 756 bp, Artificial Sequence; identical to SEQ ID NO: 728
  Synthetic Polynucleotide encoding a scFv

SEQ ID NO: 8444 - DNA, 747 bp, Artificial Sequence; identical to SEQ ID NO: 729
  Synthetic Polynucleotide encoding a scFv

SEQ ID NO: 8445 - DNA, 723 bp, Artificial Sequence; identical to SEQ ID NO: 730
  Synthetic Polynucleotide encoding a scFv

SEQ ID NO: 8446 - DNA, 702 bp, Artificial Sequence; identical to SEQ ID NO: 731
  Synthetic Polynucleotide encoding a scFv

SEQ ID NO: 8447 - DNA, 717 bp, Artificial Sequence; identical to SEQ ID NO: 732
  Synthetic Polynucleotide encoding a scFv

SEQ ID NO: 8448 - DNA, 726 bp, Artificial Sequence; identical to SEQ ID NO: 733
  Synthetic Polynucleotide encoding a scFv

SEQ ID NO: 8449 - DNA, 741 bp, Artificial Sequence; identical to SEQ ID NO: 734
  Synthetic Polynucleotide encoding a scFv

SEQ ID NO: 8450 - DNA, 774 bp, Artificial Sequence; identical to SEQ ID NO: 739
  Synthetic Polynucleotide encoding a scFv

SEQ ID NO: 8451 - DNA, 732 bp, Artificial Sequence; identical to SEQ ID NO: 740
  Synthetic Polynucleotide encoding a scFv

SEQ ID NO: 8452 - DNA, 723 bp, Artificial Sequence; identical to SEQ ID NO: 741
  Synthetic Polynucleotide encoding a scFv

SEQ ID NO: 8453 - DNA, 726 bp, Artificial Sequence; identical to SEQ ID NO: 742
  Synthetic Polynucleotide encoding a scFv

SEQ ID NO: 8454 - DNA, 744 bp, Artificial Sequence; identical to SEQ ID NO: 749
  Synthetic Polynucleotide encoding a scFv

SEQ ID NO: 8455 - DNA, 744 bp, Artificial Sequence; identical to SEQ ID NO: 750
  Synthetic Polynucleotide encoding a scFv

SEQ ID NO: 8456 - DNA, 738 bp, Artificial Sequence; identical to SEQ ID NO: 751
  Synthetic Polynucleotide encoding a scFv

SEQ ID NO: 8457 - DNA, 723 bp, Artificial Sequence; identical to SEQ ID NO: 752
  Synthetic Polynucleotide encoding a scFv

SEQ ID NO: 8458 - DNA, 723 bp, Artificial Sequence; identical to SEQ ID NO: 753
  Synthetic Polynucleotide encoding a scFv

SEQ ID NO: 8459 - DNA, 735 bp, Artificial Sequence; identical to SEQ ID NO: 754
  Synthetic Polynucleotide encoding a scFv

SEQ ID NO: 8460 - DNA, 708 bp, Artificial Sequence; identical to SEQ ID NO: 755
  Synthetic Polynucleotide encoding a scFv

SEQ ID NO: 8461 - DNA, 723 bp, Artificial Sequence; identical to SEQ ID NO: 756
  Synthetic Polynucleotide encoding a scFv

SEQ ID NO: 8462 - DNA, 744 bp, Artificial Sequence; identical to SEQ ID NO: 757
  Synthetic Polynucleotide encoding a scFv

SEQ ID NO: 8463 - DNA, 747 bp, Artificial Sequence; identical to SEQ ID NO: 758
  Synthetic Polynucleotide encoding a scFv

SEQ ID NO: 8464 - DNA, 738 bp, Artificial Sequence; identical to SEQ ID NO: 759
  Synthetic Polynucleotide encoding a scFv

SEQ ID NO: 8465 - DNA, 732 bp, Artificial Sequence; identical to SEQ ID NO: 760
  Synthetic Polynucleotide encoding a scFv

SEQ ID NO: 8466 - DNA, 738 bp, Artificial Sequence; identical to SEQ ID NO: 763
  Synthetic Polynucleotide encoding a scFv

SEQ ID NO: 8467 - DNA, 735 bp, Artificial Sequence; identical to SEQ ID NO: 764
  Synthetic Polynucleotide encoding a scFv

SEQ ID NO: 8468 - DNA, 747 bp, Artificial Sequence; identical to SEQ ID NO: 765
  Synthetic Polynucleotide encoding a scFv

SEQ ID NO: 8469 - DNA, 723 bp, Artificial Sequence; identical to SEQ ID NO: 766
  Synthetic Polynucleotide encoding a scFv

SEQ ID NO: 8470 - DNA, 717 bp, Artificial Sequence; identical to SEQ ID NO: 767
  Synthetic Polynucleotide encoding a scFv

SEQ ID NO: 8471 - DNA, 726 bp, Artificial Sequence; identical to SEQ ID NO: 768
  Synthetic Polynucleotide encoding a scFv

SEQ ID NO: 8472 - DNA, 732 bp, Artificial Sequence; identical to SEQ ID NO: 769
  Synthetic Polynucleotide encoding a scFv

SEQ ID NO: 8473 - DNA, 747 bp, Artificial Sequence; identical to SEQ ID NO: 770
  Synthetic Polynucleotide encoding a scFv

SEQ ID NO: 8474 - DNA, 729 bp, Artificial Sequence; identical to SEQ ID NO: 771
  Synthetic Polynucleotide encoding a scFv

SEQ ID NO: 8475 - DNA, 732 bp, Artificial Sequence; identical to SEQ ID NO: 772
  Synthetic Polynucleotide encoding a scFv

SEQ ID NO: 8476 - DNA, 729 bp, Artificial Sequence; identical to SEQ ID NO: 773
  Synthetic Polynucleotide encoding a scFv

SEQ ID NO: 8477 - DNA, 726 bp, Artificial Sequence; identical to SEQ ID NO: 774
  Synthetic Polynucleotide encoding a scFv

SEQ ID NO: 8478 - DNA, 726 bp, Artificial Sequence; identical to SEQ ID NO: 777
  Synthetic Polynucleotide encoding a scFv

SEQ ID NO: 8479 - DNA, 756 bp, Artificial Sequence; identical to SEQ ID NO: 778
  Synthetic Polynucleotide encoding a scFv

SEQ ID NO: 8480 - DNA, 726 bp, Artificial Sequence; identical to SEQ ID NO: 779
  Synthetic Polynucleotide encoding a scFv

SEQ ID NO: 8481 - DNA, 723 bp, Artificial Sequence; identical to SEQ ID NO: 780
  Synthetic Polynucleotide encoding a scFv

SEQ ID NO: 8482 - DNA, 726 bp, Artificial Sequence; identical to SEQ ID NO: 781
  Synthetic Polynucleotide encoding a scFv

SEQ ID NO: 8483 - DNA, 723 bp, Artificial Sequence; identical to SEQ ID NO: 782
  Synthetic Polynucleotide encoding a scFv

SEQ ID NO: 8484 - DNA, 747 bp, Artificial Sequence; identical to SEQ ID NO: 783
  Synthetic Polynucleotide encoding a scFv

SEQ ID NO: 8485 - DNA, 765 bp, Artificial Sequence; identical to SEQ ID NO: 784
  Synthetic Polynucleotide encoding a scFv

SEQ ID NO: 8486 - DNA, 720 bp, Artificial Sequence; identical to SEQ ID NO: 785
  Synthetic Polynucleotide encoding a scFv

SEQ ID NO: 8487 - DNA, 750 bp, Artificial Sequence; identical to SEQ ID NO: 786
  Synthetic Polynucleotide encoding a scFv

SEQ ID NO: 8488 - DNA, 735 bp, Artificial Sequence; identical to SEQ ID NO: 788
  Synthetic Polynucleotide encoding a scFv

SEQ ID NO: 8489 - DNA, 756 bp, Artificial Sequence; identical to SEQ ID NO: 791
  Synthetic Polynucleotide encoding a scFv

SEQ ID NO: 8490 - DNA, 738 bp, Artificial Sequence; identical to SEQ ID NO: 792
  Synthetic Polynucleotide encoding a scFv

SEQ ID NO: 8491 - DNA, 690 bp, Artificial Sequence; identical to SEQ ID NO: 793
  Synthetic Polynucleotide encoding a scFv

SEQ ID NO: 8492 - DNA, 720 bp, Artificial Sequence; identical to SEQ ID NO: 794
  Synthetic Polynucleotide encoding a scFv

SEQ ID NO: 8493 - DNA, 732 bp, Artificial Sequence; identical to SEQ ID NO: 795
  Synthetic Polynucleotide encoding a scFv

SEQ ID NO: 8494 - DNA, 750 bp, Artificial Sequence; identical to SEQ ID NO: 796
  Synthetic Polynucleotide encoding a scFv

SEQ ID NO: 8495 - DNA, 720 bp, Artificial Sequence; identical to SEQ ID NO: 797
  Synthetic Polynucleotide encoding a scFv

SEQ ID NO: 8496 - DNA, 723 bp, Artificial Sequence; identical to SEQ ID NO: 798
  Synthetic Polynucleotide encoding a scFv

SEQ ID NO: 8497 - DNA, 735 bp, Artificial Sequence; identical to SEQ ID NO: 799
  Synthetic Polynucleotide encoding a scFv

SEQ ID NO: 8498 - DNA, 720 bp, Artificial Sequence; identical to SEQ ID NO: 800
  Synthetic Polynucleotide encoding a scFv

SEQ ID NO: 8499 - DNA, 723 bp, Artificial Sequence; identical to SEQ ID NO: 801
  Synthetic Polynucleotide encoding a scFv

SEQ ID NO: 8500 - DNA, 747 bp, Artificial Sequence; identical to SEQ ID NO: 802
  Synthetic Polynucleotide encoding a scFv

SEQ ID NO: 8501 - DNA, 732 bp, Artificial Sequence; identical to SEQ ID NO: 803
  Synthetic Polynucleotide encoding a scFv

SEQ ID NO: 8502 - DNA, 753 bp, Artificial Sequence; identical to SEQ ID NO: 804
  Synthetic Polynucleotide encoding a scFv

SEQ ID NO: 8503 - DNA, 744 bp, Artificial Sequence; identical to SEQ ID NO: 805
  Synthetic Polynucleotide encoding a scFv

SEQ ID NO: 8504 - DNA, 726 bp, Artificial Sequence; identical to SEQ ID NO: 806
  Synthetic Polynucleotide encoding a scFv

SEQ ID NO: 8505 - DNA, 726 bp, Artificial Sequence; identical to SEQ ID NO: 807
  Synthetic Polynucleotide encoding a scFv

SEQ ID NO: 8506 - DNA, 720 bp, Artificial Sequence; identical to SEQ ID NO: 808
  Synthetic Polynucleotide encoding a scFv

SEQ ID NO: 8507 - DNA, 720 bp, Artificial Sequence; identical to SEQ ID NO: 809
  Synthetic Polynucleotide encoding a scFv

SEQ ID NO: 8508 - DNA, 723 bp, Artificial Sequence; identical to SEQ ID NO: 810
  Synthetic Polynucleotide encoding a scFv

SEQ ID NO: 8509 - DNA, 726 bp, Artificial Sequence; identical to SEQ ID NO: 811
  Synthetic Polynucleotide encoding a scFv

SEQ ID NO: 8510 - DNA, 723 bp, Artificial Sequence; identical to SEQ ID NO: 812
  Synthetic Polynucleotide encoding a scFv

SEQ ID NO: 8511 - DNA, 732 bp, Artificial Sequence; identical to SEQ ID NO: 813
  Synthetic Polynucleotide encoding a scFv

SEQ ID NO: 8512 - DNA, 735 bp, Artificial Sequence; identical to SEQ ID NO: 814
  Synthetic Polynucleotide encoding a scFv

SEQ ID NO: 8513 - DNA, 732 bp, Artificial Sequence; identical to SEQ ID NO: 815
  Synthetic Polynucleotide encoding a scFv

SEQ ID NO: 8514 - DNA, 741 bp, Artificial Sequence; identical to SEQ ID NO: 816
  Synthetic Polynucleotide encoding a scFv

SEQ ID NO: 8515 - DNA, 750 bp, Artificial Sequence; identical to SEQ ID NO: 817
  Synthetic Polynucleotide encoding a scFv

SEQ ID NO: 8516 - DNA, 747 bp, Artificial Sequence; identical to SEQ ID NO: 818
  Synthetic Polynucleotide encoding a scFv

SEQ ID NO: 8517 - DNA, 717 bp, Artificial Sequence; identical to SEQ ID NO: 819
  Synthetic Polynucleotide encoding a scFv

SEQ ID NO: 8518 - DNA, 723 bp, Artificial Sequence; identical to SEQ ID NO: 820
  Synthetic Polynucleotide encoding a scFv

SEQ ID NO: 8519 - DNA, 735 bp, Artificial Sequence; identical to SEQ ID NO: 821
  Synthetic Polynucleotide encoding a scFv

SEQ ID NO: 8520 - DNA, 732 bp, Artificial Sequence; identical to SEQ ID NO: 822
  Synthetic Polynucleotide encoding a scFv

SEQ ID NO: 8521 - DNA, 723 bp, Artificial Sequence; identical to SEQ ID NO: 823
  Synthetic Polynucleotide encoding a scFv

SEQ ID NO: 8522 - DNA, 726 bp, Artificial Sequence; identical to SEQ ID NO: 824
  Synthetic Polynucleotide encoding a scFv

SEQ ID NO: 8523 - DNA, 720 bp, Artificial Sequence; identical to SEQ ID NO: 825
  Synthetic Polynucleotide encoding a scFv

SEQ ID NO: 8524 - DNA, 774 bp, Artificial Sequence; identical to SEQ ID NO: 826
  Synthetic Polynucleotide encoding a scFv

SEQ ID NO: 8525 - DNA, 765 bp, Artificial Sequence; identical to SEQ ID NO: 827
  Synthetic Polynucleotide encoding a scFv

SEQ ID NO: 8526 - DNA, 690 bp, Artificial Sequence; identical to SEQ ID NO: 828
  Synthetic Polynucleotide encoding a scFv

SEQ ID NO: 8527 - DNA, 735 bp, Artificial Sequence; identical to SEQ ID NO: 829
  Synthetic Polynucleotide encoding a scFv

SEQ ID NO: 8528 - DNA, 711 bp, Artificial Sequence; identical to SEQ ID NO: 830
  Synthetic Polynucleotide encoding a scFv

SEQ ID NO: 8529 - DNA, 714 bp, Artificial Sequence; identical to SEQ ID NO: 831
  Synthetic Polynucleotide encoding a scFv

SEQ ID NO: 8530 - DNA, 714 bp, Artificial Sequence; identical to SEQ ID NO: 832
  Synthetic Polynucleotide encoding a scFv

SEQ ID NO: 8531 - DNA, 723 bp, Artificial Sequence; identical to SEQ ID NO: 833
  Synthetic Polynucleotide encoding a scFv

SEQ ID NO: 8532 - DNA, 729 bp, Artificial Sequence; identical to SEQ ID NO: 834
  Synthetic Polynucleotide encoding a scFv

SEQ ID NO: 8533 - DNA, 822 bp, Artificial Sequence; identical to SEQ ID NO: 835
  Synthetic Polynucleotide encoding a scFv

SEQ ID NO: 8534 - DNA, 747 bp, Artificial Sequence; identical to SEQ ID NO: 836
  Synthetic Polynucleotide encoding a scFv

SEQ ID NO: 8535 - DNA, 735 bp, Artificial Sequence; identical to SEQ ID NO: 837
  Synthetic Polynucleotide encoding a scFv

SEQ ID NO: 8536 - DNA, 720 bp, Artificial Sequence; identical to SEQ ID NO: 838
  Synthetic Polynucleotide encoding a scFv

SEQ ID NO: 8537 - DNA, 729 bp, Artificial Sequence; identical to SEQ ID NO: 839
  Synthetic Polynucleotide encoding a scFv

SEQ ID NO: 8538 - DNA, 756 bp, Artificial Sequence; identical to SEQ ID NO: 840
  Synthetic Polynucleotide encoding a scFv

SEQ ID NO: 8539 - DNA, 729 bp, Artificial Sequence; identical to SEQ ID NO: 841
  Synthetic Polynucleotide encoding a scFv

SEQ ID NO: 8540 - DNA, 738 bp, Artificial Sequence; identical to SEQ ID NO: 842
  Synthetic Polynucleotide encoding a scFv

SEQ ID NO: 8541 - DNA, 726 bp, Artificial Sequence; identical to SEQ ID NO: 843
  Synthetic Polynucleotide encoding a scFv

SEQ ID NO: 8542 - DNA, 726 bp, Artificial Sequence; identical to SEQ ID NO: 844
  Synthetic Polynucleotide encoding a scFv

SEQ ID NO: 8543 - DNA, 741 bp, Artificial Sequence; identical to SEQ ID NO: 845
  Synthetic Polynucleotide encoding a scFv

SEQ ID NO: 8544 - DNA, 729 bp, Artificial Sequence; identical to SEQ ID NO: 847
  Synthetic Polynucleotide encoding a scFv

SEQ ID NO: 8545 - DNA, 756 bp, Artificial Sequence; identical to SEQ ID NO: 848
  Synthetic Polynucleotide encoding a scFv

SEQ ID NO: 8546 - DNA, 726 bp, Artificial Sequence; identical to SEQ ID NO: 849
  Synthetic Polynucleotide encoding a scFv

SEQ ID NO: 8547 - DNA, 717 bp, Artificial Sequence; identical to SEQ ID NO: 850
  Synthetic Polynucleotide encoding a scFv

SEQ ID NO: 8548 - DNA, 732 bp, Artificial Sequence; identical to SEQ ID NO: 851
  Synthetic Polynucleotide encoding a scFv

SEQ ID NO: 8549 - DNA, 729 bp, Artificial Sequence; identical to SEQ ID NO: 852
  Synthetic Polynucleotide encoding a scFv

SEQ ID NO: 8550 - DNA, 735 bp, Artificial Sequence; identical to SEQ ID NO: 853
  Synthetic Polynucleotide encoding a scFv

SEQ ID NO: 8551 - DNA, 723 bp, Artificial Sequence; identical to SEQ ID NO: 854
  Synthetic Polynucleotide encoding a scFv

SEQ ID NO: 8552 - DNA, 717 bp, Artificial Sequence; identical to SEQ ID NO: 855
  Synthetic Polynucleotide encoding a scFv

SEQ ID NO: 8553 - DNA, 750 bp, Artificial Sequence; identical to SEQ ID NO: 856
  Synthetic Polynucleotide encoding a scFv

SEQ ID NO: 8554 - DNA, 735 bp, Artificial Sequence; identical to SEQ ID NO: 857
  Synthetic Polynucleotide encoding a scFv

SEQ ID NO: 8555 - DNA, 747 bp, Artificial Sequence; identical to SEQ ID NO: 858
  Synthetic Polynucleotide encoding a scFv

SEQ ID NO: 8556 - DNA, 741 bp, Artificial Sequence; identical to SEQ ID NO: 859
  Synthetic Polynucleotide encoding a scFv

SEQ ID NO: 8557 - DNA, 753 bp, Artificial Sequence; identical to SEQ ID NO: 860
  Synthetic Polynucleotide encoding a scFv

SEQ ID NO: 8558 - DNA, 735 bp, Artificial Sequence; identical to SEQ ID NO: 861
  Synthetic Polynucleotide encoding a scFv

SEQ ID NO: 8559 - DNA, 735 bp, Artificial Sequence; identical to SEQ ID NO: 862
  Synthetic Polynucleotide encoding a scFv

SEQ ID NO: 8560 - DNA, 735 bp, Artificial Sequence; identical to SEQ ID NO: 863
  Synthetic Polynucleotide encoding a scFv

SEQ ID NO: 8561 - DNA, 738 bp, Artificial Sequence; identical to SEQ ID NO: 864
  Synthetic Polynucleotide encoding a scFv

SEQ ID NO: 8562 - DNA, 720 bp, Artificial Sequence; identical to SEQ ID NO: 865
  Synthetic Polynucleotide encoding a scFv

SEQ ID NO: 8563 - DNA, 732 bp, Artificial Sequence; identical to SEQ ID NO: 709
  Synthetic Polynucleotide encoding a scFv

SEQ ID NO: 8564 - DNA, 726 bp, Artificial Sequence; identical to SEQ ID NO: 866
  Synthetic Polynucleotide encoding a scFv

SEQ ID NO: 8565 - DNA, 723 bp, Artificial Sequence; identical to SEQ ID NO: 867
  Synthetic Polynucleotide encoding a scFv

SEQ ID NO: 8566 - DNA, 729 bp, Artificial Sequence; identical to SEQ ID NO: 868
  Synthetic Polynucleotide encoding a scFv

SEQ ID NO: 8567 - DNA, 702 bp, Artificial Sequence; identical to SEQ ID NO: 869
  Synthetic Polynucleotide encoding a scFv

SEQ ID NO: 8568 - DNA, 711 bp, Artificial Sequence; identical to SEQ ID NO: 870
  Synthetic Polynucleotide encoding a scFv

SEQ ID NO: 8569 - DNA, 732 bp, Artificial Sequence; identical to SEQ ID NO: 871
  Synthetic Polynucleotide encoding a scFv

SEQ ID NO: 8570 - DNA, 744 bp, Artificial Sequence; identical to SEQ ID NO: 872
  Synthetic Polynucleotide encoding a scFv

SEQ ID NO: 8571 - DNA, 720 bp, Artificial Sequence; identical to SEQ ID NO: 873
  Synthetic Polynucleotide encoding a scFv

SEQ ID NO: 8572 - DNA, 723 bp, Artificial Sequence; identical to SEQ ID NO: 874
  Synthetic Polynucleotide encoding a scFv

SEQ ID NO: 8573 - DNA, 726 bp, Artificial Sequence; identical to SEQ ID NO: 875
  Synthetic Polynucleotide encoding a scFv

SEQ ID NO: 8574 - DNA, 747 bp, Artificial Sequence; identical to SEQ ID NO: 646
  Synthetic Polynucleotide encoding a scFv

SEQ ID NO: 8575 - DNA, 747 bp, Artificial Sequence; identical to SEQ ID NO: 646
  Synthetic Polynucleotide encoding a scFv

SEQ ID NO: 8576 - DNA, 801 bp, Artificial Sequence; identical to SEQ ID NO: 649
  Synthetic Polynucleotide encoding a scFv

SEQ ID NO: 8577 - DNA, 747 bp, Artificial Sequence; identical to SEQ ID NO: 650
  Synthetic Polynucleotide encoding a scFv

SEQ ID NO: 8578 - DNA, 738 bp, Artificial Sequence; identical to SEQ ID NO: 651
  Synthetic Polynucleotide encoding a scFv

SEQ ID NO: 8579 - DNA, 735 bp, Artificial Sequence; identical to SEQ ID NO: 652
  Synthetic Polynucleotide encoding a scFv

SEQ ID NO: 8580 - DNA, 774 bp, Artificial Sequence; identical to SEQ ID NO: 653
  Synthetic Polynucleotide encoding a scFv

SEQ ID NO: 8581 - DNA, 732 bp, Artificial Sequence; identical to SEQ ID NO: 654
  Synthetic Polynucleotide encoding a scFv

SEQ ID NO: 8582 - DNA, 756 bp, Artificial Sequence; identical to SEQ ID NO: 655
  Synthetic Polynucleotide encoding a scFv

SEQ ID NO: 8583 - DNA, 729 bp, Artificial Sequence; identical to SEQ ID NO: 656
  Synthetic Polynucleotide encoding a scFv

SEQ ID NO: 8584 - DNA, 747 bp, Artificial Sequence; identical to SEQ ID NO: 657
  Synthetic Polynucleotide encoding a scFv

SEQ ID NO: 8585 - DNA, 762 bp, Artificial Sequence; identical to SEQ ID NO: 658
  Synthetic Polynucleotide encoding a scFv

SEQ ID NO: 8586 - DNA, 762 bp, Artificial Sequence; identical to SEQ ID NO: 668
  Synthetic Polynucleotide encoding a scFv

SEQ ID NO: 8587 - DNA, 729 bp, Artificial Sequence; identical to SEQ ID NO: 669
  Synthetic Polynucleotide encoding a scFv

SEQ ID NO: 8588 - DNA, 732 bp, Artificial Sequence; identical to SEQ ID NO: 670
  Synthetic Polynucleotide encoding a scFv

SEQ ID NO: 8589 - DNA, 741 bp, Artificial Sequence; identical to SEQ ID NO: 678
  Synthetic Polynucleotide encoding a scFv

SEQ ID NO: 8590 - DNA, 735 bp, Artificial Sequence; identical to SEQ ID NO: 679
  Synthetic Polynucleotide encoding a scFv

SEQ ID NO: 8591 - DNA, 732 bp, Artificial Sequence; identical to SEQ ID NO: 680
  Synthetic Polynucleotide encoding a scFv

SEQ ID NO: 8592 - DNA, 726 bp, Artificial Sequence; identical to SEQ ID NO: 681
  Synthetic Polynucleotide encoding a scFv

SEQ ID NO: 8593 - DNA, 762 bp, Artificial Sequence; identical to SEQ ID NO: 682
  Synthetic Polynucleotide encoding a scFv

SEQ ID NO: 8594 - DNA, 738 bp, Artificial Sequence; identical to SEQ ID NO: 683
  Synthetic Polynucleotide encoding a scFv

SEQ ID NO: 8595 - DNA, 732 bp, Artificial Sequence; identical to SEQ ID NO: 680
  Synthetic Polynucleotide encoding a scFv

SEQ ID NO: 8596 - DNA, 729 bp, Artificial Sequence; identical to SEQ ID NO: 685
  Synthetic Polynucleotide encoding a scFv

SEQ ID NO: 8597 - DNA, 735 bp, Artificial Sequence; identical to SEQ ID NO: 686
  Synthetic Polynucleotide encoding a scFv

SEQ ID NO: 8598 - DNA, 786 bp, Artificial Sequence; identical to SEQ ID NO: 687
  Synthetic Polynucleotide encoding a scFv

SEQ ID NO: 8599 - DNA, 729 bp, Artificial Sequence; identical to SEQ ID NO: 688
  Synthetic Polynucleotide encoding a scFv

SEQ ID NO: 8600 - DNA, 738 bp, Artificial Sequence; identical to SEQ ID NO: 691
  Synthetic Polynucleotide encoding a scFv

SEQ ID NO: 8601 - DNA, 819 bp, Artificial Sequence; identical to SEQ ID NO: 697
  Synthetic Polynucleotide encoding a scFv

SEQ ID NO: 8602 - DNA, 816 bp, Artificial Sequence; identical to SEQ ID NO: 698
  Synthetic Polynucleotide encoding a scFv

SEQ ID NO: 8603 - DNA, 717 bp, Artificial Sequence; identical to SEQ ID NO: 699
  Synthetic Polynucleotide encoding a scFv

SEQ ID NO: 8604 - DNA, 732 bp, Artificial Sequence; identical to SEQ ID NO: 700
  Synthetic Polynucleotide encoding a scFv

SEQ ID NO: 8605 - DNA, 729 bp, Artificial Sequence; identical to SEQ ID NO: 701
  Synthetic Polynucleotide encoding a scFv

SEQ ID NO: 8606 - DNA, 720 bp, Artificial Sequence; identical to SEQ ID NO: 702
  Synthetic Polynucleotide encoding a scFv

SEQ ID NO: 8607 - DNA, 723 bp, Artificial Sequence; identical to SEQ ID NO: 707
  Synthetic Polynucleotide encoding a scFv

SEQ ID NO: 8608 - DNA, 744 bp, Artificial Sequence; identical to SEQ ID NO: 710
  Synthetic Polynucleotide encoding a scFv

SEQ ID NO: 8609 - DNA, 744 bp, Artificial Sequence; identical to SEQ ID NO: 711
  Synthetic Polynucleotide encoding a scFv

SEQ ID NO: 8610 - DNA, 726 bp, Artificial Sequence; identical to SEQ ID NO: 712
  Synthetic Polynucleotide encoding a scFv

SEQ ID NO: 8611 - DNA, 732 bp, Artificial Sequence; identical to SEQ ID NO: 713
  Synthetic Polynucleotide encoding a scFv

SEQ ID NO: 8612 - DNA, 723 bp, Artificial Sequence; identical to SEQ ID NO: 714
  Synthetic Polynucleotide encoding a scFv

SEQ ID NO: 8613 - DNA, 726 bp, Artificial Sequence; identical to SEQ ID NO: 715
  Synthetic Polynucleotide encoding a scFv

SEQ ID NO: 8614 - DNA, 714 bp, Artificial Sequence; identical to SEQ ID NO: 716
  Synthetic Polynucleotide encoding a scFv

SEQ ID NO: 8615 - DNA, 807 bp, Artificial Sequence; identical to SEQ ID NO: 717
  Synthetic Polynucleotide encoding a scFv

SEQ ID NO: 8616 - DNA, 720 bp, Artificial Sequence; identical to SEQ ID NO: 718
  Synthetic Polynucleotide encoding a scFv

SEQ ID NO: 8617 - DNA, 747 bp, Artificial Sequence; identical to SEQ ID NO: 719
  Synthetic Polynucleotide encoding a scFv

SEQ ID NO: 8618 - DNA, 759 bp, Artificial Sequence; identical to SEQ ID NO: 720
  Synthetic Polynucleotide encoding a scFv

SEQ ID NO: 8619 - DNA, 726 bp, Artificial Sequence; identical to SEQ ID NO: 735
  Synthetic Polynucleotide encoding a scFv

SEQ ID NO: 8620 - DNA, 744 bp, Artificial Sequence; identical to SEQ ID NO: 736
  Synthetic Polynucleotide encoding a scFv

SEQ ID NO: 8621 - DNA, 738 bp, Artificial Sequence; identical to SEQ ID NO: 737
  Synthetic Polynucleotide encoding a scFv

SEQ ID NO: 8622 - DNA, 738 bp, Artificial Sequence; identical to SEQ ID NO: 738
  Synthetic Polynucleotide encoding a scFv

SEQ ID NO: 8623 - DNA, 732 bp, Artificial Sequence; identical to SEQ ID NO: 743
  Synthetic Polynucleotide encoding a scFv

SEQ ID NO: 8624 - DNA, 735 bp, Artificial Sequence; identical to SEQ ID NO: 744
  Synthetic Polynucleotide encoding a scFv

SEQ ID NO: 8625 - DNA, 735 bp, Artificial Sequence; identical to SEQ ID NO: 745
  Synthetic Polynucleotide encoding a scFv

SEQ ID NO: 8626 - DNA, 735 bp, Artificial Sequence; identical to SEQ ID NO: 746
  Synthetic Polynucleotide encoding a scFv

SEQ ID NO: 8627 - DNA, 729 bp, Artificial Sequence; identical to SEQ ID NO: 747
  Synthetic Polynucleotide encoding a scFv

SEQ ID NO: 8628 - DNA, 729 bp, Artificial Sequence; identical to SEQ ID NO: 748
  Synthetic Polynucleotide encoding a scFv

SEQ ID NO: 8629 - DNA, 765 bp, Artificial Sequence; identical to SEQ ID NO: 761
  Synthetic Polynucleotide encoding a scFv

SEQ ID NO: 8630 - DNA, 753 bp, Artificial Sequence; identical to SEQ ID NO: 762
  Synthetic Polynucleotide encoding a scFv

SEQ ID NO: 8631 - DNA, 726 bp, Artificial Sequence; identical to SEQ ID NO: 775
  Synthetic Polynucleotide encoding a scFv

SEQ ID NO: 8632 - DNA, 732 bp, Artificial Sequence; identical to SEQ ID NO: 776
  Synthetic Polynucleotide encoding a scFv

SEQ ID NO: 8633 - DNA, 738 bp, Artificial Sequence; identical to SEQ ID NO: 787
  Synthetic Polynucleotide encoding a scFv

SEQ ID NO: 8634 - DNA, 750 bp, Artificial Sequence; identical to SEQ ID NO: 789
  Synthetic Polynucleotide encoding a scFv

SEQ ID NO: 8635 - DNA, 741 bp, Artificial Sequence; identical to SEQ ID NO: 790
  Synthetic Polynucleotide encoding a scFv

SEQ ID NO: 8636 - DNA, 720 bp, Artificial Sequence; identical to SEQ ID NO: 846
  Synthetic Polynucleotide encoding a scFv

SEQ ID NO: 8637 - DNA, 741 bp, Artificial Sequence; identical to SEQ ID NO: 876
  Synthetic Polynucleotide encoding a scFv

SEQ ID NO: 8638 - DNA, 732 bp, Artificial Sequence; identical to SEQ ID NO: 877
  Synthetic Polynucleotide encoding a scFv

SEQ ID NO: 8639 - DNA, 759 bp, Artificial Sequence; identical to SEQ ID NO: 878
  Synthetic Polynucleotide encoding a scFv

SEQ ID NO: 8640 - DNA, 747 bp, Artificial Sequence; identical to SEQ ID NO: 879
  Synthetic Polynucleotide encoding a scFv

SEQ ID NO: 8641 - DNA, 702 bp, Artificial Sequence; identical to SEQ ID NO: 880
  Synthetic Polynucleotide encoding a scFv

SEQ ID NO: 8642 - DNA, 759 bp, Artificial Sequence; identical to SEQ ID NO: 881
  Synthetic Polynucleotide encoding a scFv

SEQ ID NO: 8643 - DNA, 729 bp, Artificial Sequence; identical to SEQ ID NO: 882
  Synthetic Polynucleotide encoding a scFv

SEQ ID NO: 8644 - DNA, 738 bp, Artificial Sequence; identical to SEQ ID NO: 883
  Synthetic Polynucleotide encoding a scFv

SEQ ID NO: 8645 - DNA, 714 bp, Artificial Sequence; identical to SEQ ID NO: 884
  Synthetic Polynucleotide encoding a scFv

SEQ ID NO: 8646 - DNA, 738 bp, Artificial Sequence; identical to SEQ ID NO: 885
  Synthetic Polynucleotide encoding a scFv

SEQ ID NO: 8647 - DNA, 732 bp, Artificial Sequence; identical to SEQ ID NO: 886
  Synthetic Polynucleotide encoding a scFv

SEQ ID NO: 8648 - DNA, 747 bp, Artificial Sequence; identical to SEQ ID NO: 887
  Synthetic Polynucleotide encoding a scFv

SEQ ID NO: 8649 - DNA, 729 bp, Artificial Sequence; identical to SEQ ID NO: 888
  Synthetic Polynucleotide encoding a scFv

SEQ ID NO: 8650 - DNA, 741 bp, Artificial Sequence; identical to SEQ ID NO: 889
  Synthetic Polynucleotide encoding a scFv

SEQ ID NO: 8651 - DNA, 738 bp, Artificial Sequence; identical to SEQ ID NO: 890
  Synthetic Polynucleotide encoding a scFv

SEQ ID NO: 8652 - DNA, 720 bp, Artificial Sequence; identical to SEQ ID NO: 891
  Synthetic Polynucleotide encoding a scFv

SEQ ID NO: 8653 - DNA, 741 bp, Artificial Sequence; identical to SEQ ID NO: 892
  Synthetic Polynucleotide encoding a scFv

SEQ ID NO: 8654 - DNA, 735 bp, Artificial Sequence; identical to SEQ ID NO: 893
  Synthetic Polynucleotide encoding a scFv

SEQ ID NO: 8655 - DNA, 762 bp, Artificial Sequence; identical to SEQ ID NO: 894
  Synthetic Polynucleotide encoding a scFv

SEQ ID NO: 8656 - DNA, 756 bp, Artificial Sequence; identical to SEQ ID NO: 895
  Synthetic Polynucleotide encoding a scFv

SEQ ID NO: 8657 - DNA, 762 bp, Artificial Sequence; identical to SEQ ID NO: 896
  Synthetic Polynucleotide encoding a scFv

SEQ ID NO: 8658 - DNA, 759 bp, Artificial Sequence; identical to SEQ ID NO: 897
  Synthetic Polynucleotide encoding a scFv

SEQ ID NO: 8659 - DNA, 726 bp, Artificial Sequence; identical to SEQ ID NO: 898
  Synthetic Polynucleotide encoding a scFv

SEQ ID NO: 8660 - DNA, 732 bp, Artificial Sequence; identical to SEQ ID NO: 899
  Synthetic Polynucleotide encoding a scFv

SEQ ID NO: 8661 - DNA, 720 bp, Artificial Sequence; identical to SEQ ID NO: 900
  Synthetic Polynucleotide encoding a scFv

SEQ ID NO: 8662 - DNA, 735 bp, Artificial Sequence; identical to SEQ ID NO: 901
  Synthetic Polynucleotide encoding a scFv

SEQ ID NO: 8663 - DNA, 729 bp, Artificial Sequence; identical to SEQ ID NO: 902
  Synthetic Polynucleotide encoding a scFv

SEQ ID NO: 8664 - DNA, 714 bp, Artificial Sequence
  Synthetic Polynucleotide encoding a scFv
gaagtgcagctggttcagtctggggccgaagtgaagaagcctggcgagagcctgaagatcagctgcaaaggcagcggctacagcttcaccggctacaacatgaactgggtccgacagatgcccggcaaaggactggaatggatgggcaacatcgacccctactacggcggcaccacctacaaccggaagttcaagggccaagtgaccatcagcgccgacaagagcatcagcacagcctacctccagtggtcctctctgaaggccagcgacaccgccatgtactactgtgccagaagcgtgggacccttcgattcttggggccagggaacactggtcaccgtttctagcggcggaggcggaagtggaggcggaggatctggcggcggaggctctgagatcgtgctgacacagtctcccgccacactgtcactgtctccaggcgaaagagccacactgagctgtagagccagcgagaacgtgtacagctacctggcctggtatcagcagaagccaggacaggctccccggctgctgatctactttgccaagacactggccgagggcatccccgccagattttctggttctggcagcggcaccgatttcaccctgaccataagcagcctggaacctgaggacttcgccgtgtactattgccagcaccacagcgacaacccctggacctttggacagggcaccaaggtggaaatcaag

SEQ ID NO: 8665 - DNA, 717 bp, Artificial Sequence
  Synthetic Polynucleotide encoding a scFv
gacatccagatgacacagagccctagcagcctgtctgccagcgtgggagacagagtgaccatcacctgtcggaccagcgagaacgtgtacagctacctggcctggtatcagcagaagcctggcaaggcccctaagctgctggtgtcctttgccaagacactggccgaaggcgtgcccagcagattttctggctctggcagcggcaccgacttcaccctgaccatatctagcctgcagcctgaggacttcgccacctacttttgccagcaccacagcgacaacccctggacctttggacagggcaccaaggtggaaatcaagagaggcggaggcggaagtggaggcggaggatctggcggcggaggctctgctgttcagcttgttcagtctggggccgaagtgaagaaacccggcagctctgtgaaggtgtcctgcaaggccagcggctacagcttcaccggctacaacatgaactgggtccgacaagccccaggacagggccttgagtggatgggcaatatcgacccttactacggcggcaccacctacaaccggaagttcaagggcagagtgacactgaccgtggacaagagcagcagcaccgcctacatggaactgtccagcctgagaagcgaggacaccgccgtgtactactgcgctagaagcgtgggacctatggactattggggccagggcacactggtcaccgttagctct

SEQ ID NO: 8666 - DNA, 729 bp, Artificial Sequence
  Synthetic Polynucleotide encoding a scFv
gagatcgtgctgacacagagccctggcacactgtcactgtctccaggcgaaggcgctaccctgtcttgtagagctggacagtctgtgcggagcagctacctcggatggtatcagcagaagcctggacaggcccctcggctgttgatctacggtgcttctagcagagccacaggcatccccgatagattttctggcagcggctccggcaccgacttcaccctgacaatcagcagactggaacccgaggacttcgccgtgtactactgtcagcagtacggctacagccctcctacctttggctgcggcaccaagctggaaatcaaaggcggaggcggaagtggaggcggaggatctggcggcggaggctctgaagttcagctgcttgaaagtggtggcggcctggttcaacctggcggatctctgagactgagctgtgccgccagcggcttcacctttagcagctacgccatgagctgggtccgacaggctcctggcaaatgcctggaatgggtgtccgtgattagcggctctggcggcagacctaattacgccgagtctgtgaagggcagattcaccatcagccgggacaacagcaagaacaccctgtacctccagatgaacagcctgcgcgacgaggacacagccgtgtattattgcgccaaggtggactacagcaactacctgttcttcgactactggggccagggcaccctggtcacagtttcttct

SEQ ID NO: 8667 - DNA, 729 bp, Artificial Sequence
  Synthetic Polynucleotide encoding a scFv
gaggttcagctgctggaatctggcggaggaatggttcagcctggcggctctctgagactgtcttgtgccgccagcggcttcacctttagcagctacgccatgagctgggtccgacaggcccctggaaaatgcctggaatgggtgtccgccatctctggctctggcggcagaaccttttacgccgagtctgtggaaggccggttcaccatcagccgggacaacagcaagaacaccctgtacctccagatgaacagcctgagagccgaggacaccgccgtgtactattgcgccaagcacgactacagcaactacccctacttcgactactggggccagggcacactggtcacagtttctagcggcggaggcggaagtggaggcggaggatctggcggcggaggctctgaaatcgtgctgacacagagccccggcacactgtctcttagccctggcgaaagagccacactgagctgtagagccagccagagcatcagaagcagctacctggcctggtatcagcagaagcctggacaggctccccggctgttgatctacggtgcttctagcagagccacaggcatccccgatagattttctggcagcggctccggcaccgacttcaccctgacaatcagcagactggaacccgaggactttgccgtgtattactgccagcagtacggcgacctgcctttcacctttggctgcggcaccaagctggaaatcaag

SEQ ID NO: 8668 - DNA, 729 bp, Artificial Sequence
  Synthetic Polynucleotide encoding a scFv
gaggttcagctgctggaatctggcggaggaatggttcagcctggcggctctctgagactgtcttgtgccgccagcggcttcacctttagcacctacgccatgagctgggtccgacaggcccctggaaaatgcctggaatgggtgtccgccatctctggctctggcggcagaaccttttacgccgagtctgtggaaggccggttcaccatcagccgggacaacagcaagaacaccctgtacctccagatgaacagcctgagagccgaggacaccgccgtgtactattgcgccaagcacgactacagcaactacccctacttcgactactggggccagggcacactggtcacagtttctagcggcggaggcggaagtggaggcggaggatctggcggcggaggctctgaaatcgtgctgacacagagccccggcacactgtctcttagccctggcgaaagagccacactgagctgtagagcctctcagagcgtgcggagcacatacctggcttggtatcagcagaagcccggccaggctcctagactgctgatctacggtgccagcagcagagccacaggcatccccgatagattttctggcagcggctccggcaccgacttcaccctgacaatcagcagactggaacccgaggactttgccgtgtacagctgtcagcagtacggcgacctgcctttcacctttggctgcggcaccaagctggaaatcaag

SEQ ID NO: 8669 - DNA, 729 bp, Artificial Sequence
  Synthetic Polynucleotide encoding a scFv
gagatcgtgctgacacagagccctggcacactgtcactgtctccaggcgaaagagccacactgagctgtagagcctctcagagcgtgcggggcaattacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgtcagcagtacggctacagccccttcacctttggctgtggcaccaaggtggaaatcaaaggcggaggcggaagtggaggcggaggatctggcggcggaggctctgaagttcagctgcttgaatctggcggcggactggttcaacctggcggatctctgagactgtcttgtgccgccagcggcttcaccttcagcagctatgccatgagctgggtccgacaggcccctggcaaatgtctggaatgggtgtccgccatctctggctctggcggctctaccttttacgccgagtctgtgcagggcagattcaccatctccagagacaacagcaagaacaccctgtacctgcaagtgaacagcctgagagccgaggacacagccgtgtattattgcgccagacacgactacagcaactacccctacttcgactactggggccagggcaccctggtcacagtttcttct

SEQ ID NO: 8670 - DNA, 729 bp, Artificial Sequence
  Synthetic Polynucleotide encoding a scFv
gagatcgtgatgacacagagccccgccacactgtcactgtctccaggcgaaagagccacacctagctgtagagccagccagagcgtgtcctcttacctggcctggtatcagcagaagcctggacaggctccccggctgctgatctacgatgccagcaatagagccacaggcatccccgtgcggtttagcggatctggctctggcaccgatttcaccctgaccataagcagcctggaacctgaggacttcgccgtgtactactgcctccagaggaccaactggcctctgacctttggacagggcaccaaggtggaaatcaagcggacagttggcggaggcggaagtggaggcggaggatctggcggcggaggctctcaagttcagctgcttgaatccggtggcggcgttgtgcaacctggcagaagtctgagactgagctgtgccgccagcggcttcaccttcagcagctacatcatgcactgggtccgacaggcccctggcaaaggacttgaatgggtcgccgtgatctcctacgacggcagaaacaagtattacgccgacagcgtgaagggcagattcaccatctccagagacaacagcaagaacaccctgtacctccagatgaacagcctgagagccgaggacacagccgtgtattattgcgccaaggacaccgacggctacgacttcgattattggggccagggcacaatggtcaccgtgtctagt

SEQ ID NO: 8671 - DNA, 732 bp, Artificial Sequence
  Synthetic Polynucleotide encoding a scFv
caggttcagctgcaagagtctggccctggcctggtcaagcctagcgaaacactgagcctgacctgtaccgttagcggcggctctgtgtccagcgactactactactggtcctggatcagacagcctcctggcaaaggactggaatggctgggctacatctactacagcggcagcaccaactacaaccccagcctgaagtccagagtgaccatcagcgtggacaccagcaagaaccagttctccctgaagctgcggagcgtgaccacagccgatacagccgtgtactactgtgctagaggcgacggcgattacggcggcaactgctttgattattggggccagggcaccctggtcaccgtttctagcggcggaggcggaagtggaggcggaggatctggcggcggaggctctgaaattgtgctgacccagtctcctgccacactgtctcttagccctggcgagagagccacactgagctgtagagccagccagagcgtgtcctcttacctggcttggtatcagcagaagcccggacaggctcccagactgctgatcttcgacgccagcaatagagccacaggcatccccgccagattttccggctctggctctggcaccgatttcaccctgaccataagcagcctggaacctgaggacttcgccgtgtattattgccagcagcggagcaactggcccctgacatttggaggcggcaccaaggtggaaatcaag

SEQ ID NO: 8672 - DNA, 723 bp, Artificial Sequence
  Synthetic Polynucleotide encoding a scFv
caaattcagctggttgaatctggcggcggagtggtgcaacctggcagaagtctgagactgagctgtgccgccagcggcttcacctttggctactatgccatgcactgggtccgacaggcccctggcaaaggacttgaatgggtcgccgtgatctcctacgacggctccatcaagtattacgccgacagcgtgaagggcagattcaccatcagccgggacaacagcaagaacaccctgtacctccagatgaacagcctgagagccgaggacaccgccgtgtactactgtgccagagagggaccctacagcaactacctggattactggggccagggcaccctggtcacagtctcttctggcggaggcggaagtggaggcggaggatctggcggcggaggctctgccattcagctgacacagagcccttctagcctgagcgcctctgtgggcgacagagtgaccatcacatgtagagccagccagggcatctcttctgccctggcatggtatcagcagaagcctggcaaggcccctaagttcctgatctacgacgccagcagcctggaaagcggagtgcctagcagattttctggcagcggctccggcaccgatttcaccctgacaatatccagcctccagcctgaggacttcgccacctactactgccagcagttcaacagctaccccttcaccttcggacccggcaccaaggtggacatcaaa

SEQ ID NO: 8673 - DNA, 729 bp, Artificial Sequence
  Synthetic Polynucleotide encoding a scFv
gagatcgtgctgacacagagccctggcacactgtcactgtctccaggcgaaagagccacactgagctgtagagcctctcagagcgtgcggtctagctacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgtcagcagtacggcgacctgcctttcacctttggctgtggcaccaaggtggaaatcaaaggcggaggcggaagtggaggcggaggatctggcggcggaggctctgaagttcagctgcttgaatctggcggcggactggctcaacctggcggatctctgagactgtcttgtgccgccagcggcttcacctttagcagctacgccatgagctgggtccgacaggcccctggaaaatgcctggaatgggtgtccgccatctctggctctggcggctctaccttttacgccgagtctgtgaagggcagattcaccatcagccgggacaacagcaagaacaccctgtacctccagatgaacagcctgagagccgaggataccgccgtgtatttctgcgccaagcacgactacagcaactacccctacttcgactactggggccagggcaccctggtcacagtttcttct

SEQ ID NO: 8674 - DNA, 729 bp, Artificial Sequence
  Synthetic Polynucleotide encoding a scFv
gagatcgtgctgacacagagccctggcacactgtcactgtctccaggcgaaagagccacactgagctgtagagcctctcagagcgtgcggagcaattacctggcctggtatcagcagaagcccggacaggctcctcggctgttgatctacggtgcctctagcagagccacaggcatccccgatagattttctggcagcggctccggcaccgacttcaccctgacaatcagcagactggaacccgaggacttcgccgtgtactactgtcagcagtacggcgacctgcctttcacatttggcccaggcaccaaggtggaaatcaaaggcggaggcggaagtggaggcggaggatctggcggcggaggctctgaagttcagctgcttgaatccggcggaggcatggttcaacctggcggatctctgagactgtcctgtgccgccagcggcttcacctttagcagctacgccatgagctgggtccgacaggcacctggcaaaggactggaatgggtgtccgccatctctggctctggcggcagaaccttttacgccgagtctgtggaaggccggttcaccatcagccgggacaacagcaagaacaccctgtacctccagatgaacagcctgagagccgaggacacagccgtgtattattgcgccaagcacgactacagcaactacccctacttcgactactggggccagggcaccctggtcacagtttcttct

SEQ ID NO: 8675 - DNA, 732 bp, Artificial Sequence
  Synthetic Polynucleotide encoding a scFv
cagtctgctctgacccagcctagaagcgtgtcagcctctcctggacagagcgtgaccatcagctgtaccggcacacacaactacgtgtcctggtgccagcagaagcctggacaggctcctaagctgctgatctacgacttcaacaagcggcccagcggcgtgtccgatagattttctggcagcaccagcggcaacaccgccagcctgacaatctctggactgcaagccgatgacgagggccactacttctgttgggccttcgagaatatcggcggaggcaccaagctgacagtgcttggcggcggaggcggaagtggaggcggaggatctggcggcggaggctctgctggactgatgcagtctggcgctgtgatgaagaacagcggagccagcgtcagagtgtcctgtcaggccgatggctacgatttcatcgactacgtgatccactggttccggcagcggagaggcgaaggacttgaatggctcggctggatgaatccttctggcggcggaacaaactaccccagacctttccagggcaaagtgaccatgaccagagacaccagcaccgagacagcctacctggatgttcggggcctgacctacgatgacaccgccgtgtattactgcgtgcgggacagagccaatggcagtggcaggcggagattcgagagcgtgaactggttcctggacctgtggggcagaggcacccagatcacagtggtttctgct

SEQ ID NO: 8676 - DNA, 729 bp, Artificial Sequence
  Synthetic Polynucleotide encoding a scFv
cagtctgctctgacccagcctagaagcgtgtcagcctctcctggacagagcgtgaccatcagctgtaccggcacacacaacctggtgtcctggtgtcagcatcagcctggcagagcccctaagctgctgatctacgacttcaacaagcggcctagcggcgtgcccgatagattttctggatctggctctggcggcaccgccagcctgacaattactggcctccaggacgacgacgatgccgagtatttctgctgggcctacgaagcctttggcggaggcacaaagctgacagtgcttggaggcggaggcggaagtggaggcggaggatctggcggcggaggctctgctgatcttgttcagtctggcgctgtggtcaagaaacccggcgatagcgtgcggatctcttgcgaggctcagggctacagattccccgactacatcatccactggattcggagagccccaggccagggacctgaatggatgggctggatgaatcctatgggcggccaagtgaacatcccctggaagtttcagggcagagtgtccatgaccagagacacctctatcgagactgccttcctggacctgaggggcctgaagtctgatgacaccgccgtgtactactgcgtgcgggacagaagcaatggcagcggcaagagattcgagagcagcaactggttcctggatctgtggggaagaggcaccgctgtgacaatccagtctgct

SEQ ID NO: 8677 - DNA, 732 bp, Artificial Sequence
  Synthetic Polynucleotide encoding a scFv
cagtgtgtgctgacccagcctagatccgtgtctggctctcctggacagagcgtgaccatcagctgtaccggcacacacaactacgtgtcctggtgccagcaccatcctggcaatgcccctaagctgctgctgtacgacttcgacaaacggcccagcggcatcagcgatagattcagcggaagcagaagcggcaacaccgccagcctgacaatctctggactccagcctgaggacgaggccgactacttctgctgggcctttgaagcctttggcggaggcacaaaggtgctggttcttagaggcggaggcggaagtggaggcggaggatctggcggcggaggctcttctgctgaactggttcagtctggggccgtcgtgaagaaacctggcacctctgtgaaggtgtcctgccaggcttacggctacacctttaccgactacctgatccactggctgagacaggcccctggacaaggactggaatggatgggctggatgaaccccgtgtacggccaagtgaactacgcccagaacttccagggcagagtgtccatgaccagagacatctacagagagacagccttcctggaagtgcgggacctgaaaaccgatgacaccggcacctactactgcgtcagagatacaggcgacggcagcagaaggcacttcgacagcatcaactggtttctggacctgtggggcagaggcacctggattagagttgctcctgct

SEQ ID NO: 8678 - DNA, 705 bp, Artificial Sequence
  Synthetic Polynucleotide encoding a scFv
tacgtgcagagccagtctcctagcacactgtacgccagcgtgggcgacaagatcaccatcacctgtagaagcagccagagcggctggaaagcctggtatcagcagaagcctggcaaggcccctaagctgctgatctacaagagcagcatcctggaaaccggcgtgcccagcagattttccggcagcgatagcggcaccgagttcaccctgacaatcagcagcctccagcctgacgacttcgccacctactactgccagcacttcgagacattcggccagggcaccagagtgcaagttcgcggcggaggcggaagtggaggcggaggatctggcggcggaggctctcaaattgagctggtgcagagcggcacagaagtgaagaggccaggcgcttctgtgcggatcagctgtgcctctagcggctacagattcaccaactacttcatccactgggtccgacaggcccctggcagaggacttgaatggatgggctggatgaaccctctgcacggcggcgtgaactacagcggcagatttcagggcagagtgaccatgaccagagacatctacaccgaaaccagcttcatggtgctgtccggcctgacctccgacgacaccgccatctatttctgtaccagaggccgcgacggctacgacgatggatttcatccttggggccagggaaccctggtcacagtttctgct

SEQ ID NO: 8679 - DNA, 705 bp, Artificial Sequence; identical to SEQ ID NO: 8678
  Synthetic Polynucleotide encoding a scFv

SEQ ID NO: 8680 - DNA, 711 bp, Artificial Sequence
  Synthetic Polynucleotide encoding a scFv
gcatctgccctgactcagcctgcctccatgtctgcgtcccctggacagtcggtaaccatctcgtgctctggaaccagacacataatctctgcttggttccaacaatatccaggcaaaccacccaaactcataatttttgacgacgataagcgtccctctggagttcctagtcgcttctctgcctccaggcctggcgacacggcctccctgacaatctctaatgttcaacctgaggacgaggcgacgtacatttgcaatacatatgaattctttggcggagggaccagattgaccgtcctaagtggcggaggcggaagtggaggcggaggatctggcggcggaggctctcacgtccaattggtgcagtctggaggtggggtgaagaagattggggccgctgtgaggatctcctgcgaggtgactggatataaattcatggaccaactcataaactgggtgcggcaggcccccggtcagggccttgagtggatgggatggatgaatccaacatatggacaagtaaattattcatggagatttgaaggaagggtcaccatgaccagggacatggacaccgagacggccttcatggagttgagaggactgagagtggacgacacggccgtctattattgcgcgaggggaccctctggggaaaattatccttttcactattggggccagggtgtccgagtggtcgtctcgtcaccc

SEQ ID NO: 8681 - DNA, 705 bp, Artificial Sequence
  Synthetic Polynucleotide encoding a scFv
tacatccaggtgacccagtctccttccaccctgtctgcatctataggagacacagtcaccatcacttgccgggccagtgagggttggttggcctggtatcagcagaaaccagggaaagcccctaagctcataatttataagacctccactttggaaagaggggtcccatcaaggttcagcggcagtgtatctggggcagacttcactctcaccatcagcggcctgcagtctgatgattttgcaacttattactgccaaaagtttgaattttttggccaggggaccgtggtggacatgaaaggcggaggcggaagtggaggcggaggatctggcggcggaggctctcgggcgcagctggtgcagtctgggcctgaggtgaagaagcctggggcctcagtgaggatctcctgcgcggcttctggatacaccttcgtcgattcctttatccactggctgcgacaggcccctggacaagggcttgagtggataggatggatcaaccctctccgtggtggcgtaaactattcaggcaggtttcagggcagggtcgccatgaccaggaacacgttcaccgagacagtctacatggacatcaacgggctgacacctgacgacacggccacgtatttctgtgtgagagcccccgattcgtacgacagagggtacgacgcctggggccaaggaacccgggtcatcgtcacctca

SEQ ID NO: 8682 - DNA, 705 bp, Artificial Sequence
  Synthetic Polynucleotide encoding a scFv
tacatccaggtgacccagtctccttccaccctgtctgcatctataggagacacagtcaccatcacttgccgggccagtgagggttggttggcctggtatcagcagaaaccagggaaagcccctaagctcataatttataagacctccactttggaaagaggggtcccatcaaggttcagcggcagtgtatctggggcagacttcactctcaccatcagcggcctgcagtctgatgattttgcaacttattactgccaaaagtttgaattttttggccaggggaccgtggtggacatgaaaggcggaggcggaagtggaggcggaggatctggcggcggaggctctcgggtgcagctggtgcagtctgggcctgaggtgaagaagcctggggcctcagtgaggatctcctgcaaggcttctggatacaagttctccgactcccttatccactggctgcgacagtcccctcgagacgggcttcagtggctaggatacatgaaccctatgggtggtgccgtaaactatgcacacaggcttcagggcagggtccagatgaccagggacatcttctccgagacagcctacatggatatccgcgggctgacacctgacgacacggccacgtatttctgtgtgagagaccccgacgcatatgagcgcgggttcgacgcctggggccaaggaacccggatcgtcgtcacctca

SEQ ID NO: 8683 - DNA, 759 bp, Artificial Sequence
  Synthetic Polynucleotide encoding a scFv
gaaaatgtgttgacgcagtctccaggcaccctgtctttgtctccaggggatagagccaccctctcctgcagggccagtcagagttttagcagcagcaacttagcctggtaccagcagaaacctggccaggctcccaggctcctcatccatggtgtatccaccagggccactggcatcccagacaggttcagtggcagtgggtctgggacagacttcactctcaccatcagcagactggagcctgaagattttgcagtgtatttctgtcagcagtatgcttactcacctgcgacgttcggccaagggaccaaggtggaaatcaaaggcggaggcggaagtggaggcggaggatctggcggcggaggctctcaggtgcagctgcaggagtcgggcccaggactggtgaagccttcacagaccgtgtccctcacctgcagtgtctctggtggctccatcagcagtggtggttaccactggagctggatccgccagcacccagggaagggcctggagtggattgggtacatctatcacaatgggaacacctactacaacccgtccctcgagagtcgagttaccatatcagtagacacgtctaagaaccagttctccctgaagctgacctctgtgactgccgcggacacggccgtgtattactgtgcgagaaatagtgctagggctggaagccacctgctactcggaagggataagtcctggttcgacccctggggccaaggaaccctggtcatcgtctcctca

SEQ ID NO: 8684 - DNA, 759 bp, Artificial Sequence
  Synthetic Polynucleotide encoding a scFv
gaaaatgtgttgacgcagtctccaggcaccctgtctttgtctccaggggacagagccaccctctcctgcagggccagtcagagttttagcagcagctacttagcctggtaccagcagaaacctggccaggctcccaggctcctcatctatggtgtatccaccagggccactggcatcccagacaggttcagtggcagtgggtctgggacagacttcactctcaccatcagcagactggagcctgaagattttgcagtgtatttctgtcagcagtatgcttactcacctgcgacgttcggccaagggaccaaggtggaaatcaaaggcggaggcggaagtggaggcggaggatctggcggcggaggctctcaggtgcagctgcaggagtcgggcccaggactggtgaagccttcacagaccgtgtccctcacctgcagtgtctctggtggctccatcagcagtggtggttaccactggagctggatccgccagcacccagggaagggcctggagtggattgggtacatctattacaatgggaacacctactacaacccgtccctcgagagtcgagttaccatatcagtagacacgtctaagaaccagttctccctgaagctgacctctgtgactgccgcggacacggccgtgtattactgtgcgagaaatagtgctagggctggaagccacctgctactcggaagggataagtcctggttcgacccctggggccaaggaaccctggtcatcgtctcctca

SEQ ID NO: 8685 - DNA, 720 bp, Artificial Sequence
  Synthetic Polynucleotide encoding a scFv
gaaattgtgttgacgcagtctccaggcaccctgtctttgtctccaggggaaagagccaccctctcctgcaggaccagtcagactgttcgcagcagcttcttagcctggtaccagcagaaacctggccaggctcccagtctcctcatctatggtacatccagcagggccactggcatcccagacaggttcagtggcagtgggtctgggacagacttcactctcaccatcagcggactggagcctgaagattctgcagtgtattactgtcagcagtatggtagctcacttactttcggcggagggaccaaggtggagatcaaaggcggaggcggaagtggaggcggaggatctggcggcggaggctctcagctgcagctggtgcagtctggggctgaggtgaagaagcctggggcctcagtgaaggtctcctgcaaggcttctggagactccgtcaccggctactatatccactgggtgcgacaggcccctggacaagggcttgagtggataggatggatccgccctaacaatggtggcacaaactttccacggaagtttcagggcagggtcaccatgacctgggacacgtccctcaccacagcctacatggacctgagcgggctgacatctgacgacacggccgtgtattactgtgtgccacacaggtggccagactactttgactcctggggccaaggaaccctggtcatcgtctcctca

SEQ ID NO: 8686 - DNA, 765 bp, Artificial Sequence
  Synthetic Polynucleotide encoding a scFv
gaaattctgttgacgcagtctccaggcaccctgtctttgtctccaggggaaagagccaccctctcctgcagggccagtcagagtgttagcaccaagtacttagcctggtaccagcagaaacctggccaggctcccaggctcctcatctatggtgcatccagcagggccactggcatcccagacaggttcactggcagtgggtctgggacagacttcactctcaccatcaccagactggagcctgaagattttgcagtgtattactgtcagcagtatggtcgctcacttacattcggcccagggaccaaggtggacctcaaaggcggaggcggaagtggaggcggaggatctggcggcggaggctctctggtgcatctggtgcagtctggggctgaggtgaagaagcctgggtcctcggtgaaggtctcctgcaaggcttctggaggcaccttcagcagccatgttatcaactgggtgcgacaggcccctggacaagggcttgagtggatgggagggatcatgcctctccttggtacagcaaactacccacagaagttccagggcagagtcacgattatcgcggacgaatccacgaacacagcctacatggagctgagcagcctgagatctgaggacacggccgtgtatttctgtgcgacaagtagtgaggccgacgactacagtactgggttcgagatgggagaatactactacgactactatgtggacgtctgggggacagggaccacggtcaccgtctcctca

SEQ ID NO: 8687 - DNA, 762 bp, Artificial Sequence
  Synthetic Polynucleotide encoding a scFv
gaaattgtgttgacgcagtttccaggcaccctgtctttgtctccaggggaaggagccaccctctcctgcagggccagtcagagtattagcagcagccagttagcctggtaccagcagagacctggccaggctcccaggctcctcatctatggtgcatccagcagggccactgccatcccagacaggttcagtggcagtgggtctgggacagacttcactctcaccatcagcagactggagcctgaagattttggagtgtattactgtcagcagtatggtcgctcacttatcaccttcggccaagggacacgactggagattaaaggcggaggcggaagtggaggcggaggatctggcggcggaggctctcaggtgcagctggtgcagtctggggctgaggtgaagaagcctgggtcctcggtgaagctctcctgcaaggcttctggaggcaccttctacagctattctctcaactgggtgcgacaggcccctggacaagggcttgagtggatgggagggatcatccctttctttggttcagcaaactacgcacagaagttccagggcagagtcacgattaccgcggacgaatccacgaccacagcctacctggagctgagcaccctgagacctgatgacacggccgtgtattactgtgcgggacggggtgagactaatgactacggtgacggtggtgagttcggctactactactcctatctggacgactggggcaaagggaccacggtcaccgtctgctta

SEQ ID NO: 8688 - DNA, 762 bp, Artificial Sequence
  Synthetic Polynucleotide encoding a scFv
gaaattgtgttgacgcagtttccaggcaccctgtctttgtctccaggggaaggagccaccctctcctgcagggccagtcagagtattagcagcagccagttagcctggtaccagcagagacctggccaggctcccaggctcctcatctatggtgcatccagcagggccactgccatcccagacaggttcagtggcagtgggtctgggacagacttcactctcaccatcagcagactggagcctgaagattttgcagtgtattactgtcagcagtatggtcgctcacttatcaccttcggccaagggacacgactggagattaaaggcggaggcggaagtggaggcggaggatctggcggcggaggctctcaggtgcagctggtgcagtctggggctgaggtgaagaagcctgggtcctcggtgaagctctcctgcaaggcttctggaggcaccttctacagctattctatcaactgggtgcgacaggcccctggacaagggcttgagtggatgggagggatcatccctttctttggttcagcaaactacgcacagaagttccagggcagagtcacgattaccgcggacgaatccacgaccacagcctacctggagctgagctccctgagacctgatgacacggccgtgtattactgtgcgggacggggtgagactaatgactacgctgacggtggtgagttcggctactactactcctatatggccgactggggcaaagggaccacggtcaccgtctcctca

SEQ ID NO: 8689 - DNA, 762 bp, Artificial Sequence
  Synthetic Polynucleotide encoding a scFv
gaaattgtgttgacgcagtttccaggcaccctgtctttgtctccaggggaaagagccaccctctcctgcagggccagtcagagtgttagcagcaactacttagcctggtaccagcagaaacctggccaggctcccaggctcctcatctatggtgcatccagcagggccactgccatcccagacaggttcagtggcagtgggtctgggacagacttcactctcaccatcagcagactggagcctgaagatgttgcagtgtattactgtcagcagtatggtcgctcacttatcaccttcggccaagggacacgactggagattaaaggcggaggcggaagtggaggcggaggatctggcggcggaggctctcaggtgcagctggtgcagtctggggctgaggtgaagaagcctgggtcctcggtgaaggtctcctgcaaggcttctggaggcaccttcgaaagctattctatcaactgggtgcgacaggcccctggacaagggcttgagtggatgggagggatcatccctttctttggtgcagcaaactacgcaccgaggttccagggcagagtcacgattaccgcggacgaatccacgaccacagcctacctggaggtgaacaacctgagacctgatgacacggccgtgtattactgtgcgggacggggtgagactaatgactacggtgacgatggtcggttcggctactactactcctatatggccgactggggcaaagggaccacggtcaccgtctcctca

SEQ ID NO: 8690 - DNA, 762 bp, Artificial Sequence
  Synthetic Polynucleotide encoding a scFv
gaaattgtgttgacgcagtttccaggcaccctgtctttgtctccaggggaaagagccaccctctcctgcagggccagtcagagtgttagcagcagccaattagcctggtaccagcagaaacctggccaggctcccaggctcctcatctatggtgcatccagcagggccactgccatcccagacaggttcagtggcagtgggtctgggacagacttcactctcaccatcagcagactggagcctgaagattttgcagtgtattactgtcagcagtatggtcgcttacttatcaccttcggccaagggacacgactggagattaaaggcggaggcggaagtggaggcggaggatctggcggcggaggctctcaggtgcacctggtgcagtctggggctgaggtgaagaagcctgggtcctcggtgaaggtctcctgcagggcttctggaggcaccttcgacagctattctttcaactgggtgcgacaggcccctggacaagggcttgagtggatgggagggatcatccctttctttggtgcagcaaactacgcacagaatttccagggcagagtcacgattaccgcggacgaatccacgaccacagcctacctggagctgagctccctgagacctgatgacacggccgtgtattactgtgcgggacggggtgatactaatgactacggtgacgatggtcagttcggctactactactcctatatgggcgactggggcaaagggaccacggtcaccgtctcctca

SEQ ID NO: 8691 - DNA, 765 bp, Artificial Sequence
  Synthetic Polynucleotide encoding a scFv
gaaattgtgttgacgcagtctccaggcaccctgtctttgtctccaggggaaacagccaccctctcctgcagggccagtcagagtgttgtcagcaactacttagcctggtaccagcagaagcctggccaggctcccaggctcctcatctatggtgcatctagaagggccactgccatcccagacaggttcagtggcagtgggtctgggacagagttcactctcaccatcagcagactggagcctgaagattttgcagtctattactgtcagcagtatggtagctcacctcaggtctctttcggcggagggaccaaggtggagatcaaaggcggaggcggaagtggaggcggaggatctggcggcggaggctctcaggtccacctggtgcagtctggggctgaggtgaagaagcctagatcctcggtgagggtctcctgcgaggcttctggagggatcttcagcgacttttctttgaactgggtgcgacaggcccctggacaggggcttgagtggatgggaggaatcatccccttctttggtacagcattctacgcaccgaagttccagggcagactcaccattaccgcggacgaatccacgagcacagcctacatggacctgagcagcctgagatctgacgacacggccatgtatttctgtgcgggaagcgaaagtccgaatgagtacggtgactcgacccaatttggtttctactacaactacatggccgtctggggcaaagggaccacggtcaccgtctcctca

SEQ ID NO: 8692 - DNA, 744 bp, Artificial Sequence
  Synthetic Polynucleotide encoding a scFv
agttttatgctgactcagtccctctctgtgtcggagtctccggggaagacggtaaccatctcctgcacccgcagcagtggcaccattgccaccaactatgtgcagtggtaccagcagcgcccgggcagtgcccccaccactgtgatctttgagaatgaccgaagaccctctggggtccctgatcggttctctggctccatcgacacctcctccaactctgcctccctcaccatctctggactgaagactgaggacgaggctgactactactgtcagtcttatgataccaccgatgtgatattcggcggagggaccaagctgaccgtcctaggcggaggcggaagtggaggcggaggatctggcggcggaggctctgatgtgcagctggtgcagtctggagcagaggtgaaaaagcccggggagtctctgaagatctcctgtcaggcttctggatacacctttaccgacaactggatcgcctgggtgcgccagatgcccgggaaaggcctggagtgggtggggttcacctatcctgctgactctgataccagatacagcccgtccttccaaggccatgtcaccatctcagccgacaagtccatgaggaccgccttcctggagtggagcagcctgagggcctcggacaccgccatgtattactgtgcgagactgggtggtcaatgtaccgatggagtatgctactttgaccactggggccgaggaaccctggtcaccgtctcctca

SEQ ID NO: 8693 - DNA, 744 bp, Artificial Sequence
  Synthetic Polynucleotide encoding a scFv
agttttatgctgactcagtccctctctgtgtcggagtctccggggaagacggtaaccatctcctgcacccgcagcagtggcaccattgccaccaactatgtgcagtggtaccagcagcgcccgggcagtgcccccaccactatcatctttgagaatgaccgaagaccctctggggtccctgatcggttctctggctccatcgacacctcctccaactctgcctccctcaccatctctggactgaggactgaggacgaggctgactactactgtcagtcttatgataccaccgatgtgatattcggcggagggaccaagctgaccgtcctaggcggaggcggaagtggaggcggaggatctggcggcggaggctctgatgtgcagctggtgcagtctggagcagaggtgaaaaagcccggggagtctctgaagatctcctgtcagggttttggatacacctttaccgacaactggatcgcctgggtgcgccagatgcccgggaaaggcctggagtgggtggggttcacctatcctgatgactctgataccagatacagcccgtccttccaaggccatgtcaccatctcagccgacaagtccatgaggaccgccttcctgcagtggagcagcctgagggcctcggacaccgccatgtattactgtgcgagactgggtggtcaatgtagcgatggagtatgctactttgaccactggggccgaggaaccctggtcaccgtctcctca

SEQ ID NO: 8694 - DNA, 720 bp, Artificial Sequence
  Synthetic Polynucleotide encoding a scFv
gacatccagatgacacagagccctagcagcctgtctgccagcgtgggagacagagtgaccatcacctgtagagccagcgtgaacatctacagctacctggcctggtatcagcagaagcctggcaaggcccctaagctgctgatctacaacgccaagattctggccgagggcgtgcccagcagattttctggttctggcagcggcaccgacttcaccctgacaatatctagcctccagcctgaggacttcgccacctactactgccagcaccactacggcaccttcacctttggcggcggaacaaaggtggaaatcaagagaggcggaggcggaagtggaggcggaggatctggcggcggaggctctcaagtgcagctggttgaatcaggtggcggcgttgtgcagcctggcagaagtctgagactgagctgtgccgcctctggctttagcctgacaagctatggcgtgcactgggtccgacaggcccctggaaaaggactggaatgggtcgccgtgatttggagcgacggcagcaccacatacaacagcgccctgaagtcccggttcaccatcagcagagacaacagcaagaacaccctgtacctccagatgaactccctgagagccgacgacaccgccgtgtactattgcgccagacactacggctctaccctggcctttgcttcttggggccagggcacactggtcaccgtttcttct

SEQ ID NO: 8695 - DNA, 744 bp, Artificial Sequence
  Synthetic Polynucleotide encoding a scFv
gagatcgtgctgacacagagccctggcacactgtcactgtctccaggcgaaagagccacactgagctgcaaggccagccagaacgtgggcaacaacgtggcctggtatcagcagaagcctggacaggctccccggctgctgatctacagcgccagctacagatacagcggcatccccgatagattcagcggctctggcagcggcaccgatttcaccctgaccatcagcagactggaacccgaggacttcgccgtgtactactgccagcagtacaacacataccccttcaccttcggccagggcacaagactggaaatcaagagaggcggaggcggaagtggaggcggaggatctggcggcggaggctctgaagtgcagctggttgaatcaggtggcggcctggttcaacctggcggatctctgagactgagctgtgccgccagcggcttcacctttagcaactactggatgaactgggtccgacaggcccctggcaaaggactggaatgggttgccgagatccggttcaagtcccacaactacgccacacacttcgccgagagcgtgaagggcagattcaccatctccagagacaacgccaagaacagcctgtacctccagatgaactccctgagagtggaagataccgccgtgtattattgcgtgcggcggatcggcaacagcgactacgattggtggtacttcgacgtgtggggcagaggcacactcgtgactgttagctct

SEQ ID NO: 8696 - DNA, 735 bp, Artificial Sequence
  Synthetic Polynucleotide encoding a scFv
gacatcgtgctgacacagagccctgcttctctggccgtgtctctgggagagagagccaccatcaactgtagagccagcgagagcgtgtccgtgattggagcccacctgatccactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggaccatccccagaacattcggccagggcaccaagctggaaatcaagagaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttct

SEQ ID NO: 8697 - DNA, 735 bp, Artificial Sequence
  Synthetic Polynucleotide encoding a scFv
gacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttccggcagcggcagcagaaccgacttcaccctgaccatcagcagcgtggaacccgaggacttcgccgtgtactactgcctccagagccggaccatccccagaacattcggccagggcaccaagctggaaatcaagagaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttct

SEQ ID NO: 8698 - DNA, 735 bp, Artificial Sequence
  Synthetic Polynucleotide encoding a scFv
gacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggaccatccccagaacattcggccagggcaccaagctggaaatcaagagaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttct

SEQ ID NO: 8699 - DNA, 732 bp, Artificial Sequence
  Synthetic Polynucleotide encoding a scFv
gacatcgtgctgacacagagccctgccaccctgtctctgagccctggcgatagagccaccatcagctgtagagccagcgagagcgtgaccatcctgggcagccacctgatctactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttct

SEQ ID NO: 8700 - DNA, 732 bp, Artificial Sequence
  Synthetic Polynucleotide encoding a scFv
gacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttct

SEQ ID NO: 8701 - DNA, 732 bp, Artificial Sequence
  Synthetic Polynucleotide encoding a scFv
gacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggatcttccccagaacctttggacagggcaccaagctggaaatcaaaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttct

SEQ ID NO: 8702 - DNA, 732 bp, Artificial Sequence
  Synthetic Polynucleotide encoding a scFv
gacatcgtgctgacacagagccctgcttctctggccgtgtctctgggagagagagccaccatcaactgtagagccagcgagagcgtgtccgtgattggagcccacctgatccactggtatcagcagaagcccggccagccccccagactgctgattcagctggcctccaatgtgcagaccggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaggcggaggcggaagtggaggcggaggatctggcggcggaggctctgaacaagttcagctggtgcagtctggctccgagctgaagaaacctggcgagtccgtgaagatcagctgcaaggccagcggctacaccttcaccgactacagcatcaactgggtcaagcaggccccaggccagggcctgaagtggatgggcagaatcaacaccgagagcggcgtgcccatctacgccgacgacttcaagggccggttcagcttcaccgtggacaccagcgccagcacagcctatctccagatcagctctctgaaggccgaggataccgccgtgtacttctgcgccctggactacagctacgctatggactattggggccagggcaccctggtcacagtctcttct

SEQ ID NO: 8703 - DNA, 732 bp, Artificial Sequence; identical to SEQ ID NO: 886
  Synthetic Polynucleotide encoding a scFv

SEQ ID NO: 8704 - DNA, 1512 bp, Artificial Sequence
  Synthetic Polynucleotide encoding a CAR with optional accessory module(s)
atggccttaccagtgaccgccttgctcctgccgctggccttgctgctccacgccgccaggccgcagtctgctctgacccagcctagaagcgtgtcagcctctcctggacagagcgtgaccatcagctgtaccggcacacacaactacgtgtcctggtgccagcagaagcctggacaggctcctaagctgctgatctacgacttcaacaagcggcccagcggcgtgtccgatagattttctggcagcaccagcggcaacaccgccagcctgacaatctctggactgcaagccgatgacgagggccactacttctgttgggccttcgagaatatcggcggaggcaccaagctgacagtgcttggcggcggaggcggaagtggaggcggaggatctggcggcggaggctctgctggactgatgcagtctggcgctgtgatgaagaacagcggagccagcgtcagagtgtcctgtcaggccgatggctacgatttcatcgactacgtgatccactggttccggcagcggagaggcgaaggacttgaatggctcggctggatgaatccttctggcggcggaacaaactaccccagacctttccagggcaaagtgaccatgaccagagacaccagcaccgagacagcctacctggatgttcggggcctgacctacgatgacaccgccgtgtattactgcgtgcgggacagagccaatggcagtggcaggcggagattcgagagcgtgaactggttcctggacctgtggggcagaggcacccagatcacagtggtttctgctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 8705 - DNA, 1515 bp, Artificial Sequence
  Synthetic Polynucleotide encoding a CAR with optional accessory module(s)
atggccttaccagtgaccgccttgctcctgccgctggccttgctgctccacgccgccaggccggctggactgatgcagtctggcgctgtgatgaagaacagcggagccagcgtcagagtgtcctgtcaggccgatggctacgatttcatcgactacgtgatccactggttccggcagcggagaggcgaaggacttgaatggctcggctggatgaatccttctggcggcggaacaaactaccccagacctttccagggcaaagtgaccatgaccagagacaccagcaccgagacagcctacctggatgttcggggcctgacctacgatgacaccgccgtgtattactgcgtgcgggacagagccaatggcagtggcaggcggagattcgagagcgtgaactggttcctggacctgtggggcagaggcacccagatcacagtggtttctgctggcggaggcggaagtggaggcggaggatctggcggcggaggctcttgacagtctgctctgacccagcctagaagcgtgtcagcctctcctggacagagcgtgaccatcagctgtaccggcacacacaactacgtgtcctggtgccagcagaagcctggacaggctcctaagctgctgatctacgacttcaacaagcggcccagcggcgtgtccgatagattttctggcagcaccagcggcaacaccgccagcctgacaatctctggactgcaagccgatgacgagggccactacttctgttgggccttcgagaatatcggcggaggcaccaagctgacagtgcttggcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 8706 - DNA, 2040 bp, Artificial Sequence
  Synthetic Polynucleotide encoding a CAR with optional accessory module(s)
atggccttaccagtgaccgccttgctcctgccgctggccttgctgctccacgccgccaggccgcagtctgctctgacccagcctagaagcgtgtcagcctctcctggacagagcgtgaccatcagctgtaccggcacacacaactacgtgtcctggtgccagcagaagcctggacaggctcctaagctgctgatctacgacttcaacaagcggcccagcggcgtgtccgatagattttctggcagcaccagcggcaacaccgccagcctgacaatctctggactgcaagccgatgacgagggccactacttctgttgggccttcgagaatatcggcggaggcaccaagctgacagtgcttggcggcggaggcggaagtggaggcggaggatctggcggcggaggctctgctggactgatgcagtctggcgctgtgatgaagaacagcggagccagcgtcagagtgtcctgtcaggccgatggctacgatttcatcgactacgtgatccactggttccggcagcggagaggcgaaggacttgaatggctcggctggatgaatccttctggcggcggaacaaactaccccagacctttccagggcaaagtgaccatgaccagagacaccagcaccgagacagcctacctggatgttcggggcctgacctacgatgacaccgccgtgtattactgcgtgcgggacagagccaatggcagtggcaggcggagattcgagagcgtgaactggttcctggacctgtggggcagaggcacccagatcacagtggtttctgctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccatga

SEQ ID NO: 8707 - DNA, 2733 bp, Artificial Sequence
  Synthetic Polynucleotide encoding a CAR with optional accessory module(s)
atggccttaccagtgaccgccttgctcctgccgctggccttgctgctccacgccgccaggccgcagtctgctctgacccagcctagaagcgtgtcagcctctcctggacagagcgtgaccatcagctgtaccggcacacacaactacgtgtcctggtgccagcagaagcctggacaggctcctaagctgctgatctacgacttcaacaagcggcccagcggcgtgtccgatagattttctggcagcaccagcggcaacaccgccagcctgacaatctctggactgcaagccgatgacgagggccactacttctgttgggccttcgagaatatcggcggaggcaccaagctgacagtgcttggcggcggaggcggaagtggaggcggaggatctggcggcggaggctctgctggactgatgcagtctggcgctgtgatgaagaacagcggagccagcgtcagagtgtcctgtcaggccgatggctacgatttcatcgactacgtgatccactggttccggcagcggagaggcgaaggacttgaatggctcggctggatgaatccttctggcggcggaacaaactaccccagacctttccagggcaaagtgaccatgaccagagacaccagcaccgagacagcctacctggatgttcggggcctgacctacgatgacaccgccgtgtattactgcgtgcgggacagagccaatggcagtggcaggcggagattcgagagcgtgaactggttcctggacctgtggggcagaggcacccagatcacagtggtttctgctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8708 - DNA, 2697 bp, Artificial Sequence
  Synthetic Polynucleotide encoding a CAR with optional accessory module(s)
atggccttaccagtgaccgccttgctcctgccgctggccttgctgctccacgccgccaggccgcagtctgctctgacccagcctagaagcgtgtcagcctctcctggacagagcgtgaccatcagctgtaccggcacacacaactacgtgtcctggtgccagcagaagcctggacaggctcctaagctgctgatctacgacttcaacaagcggcccagcggcgtgtccgatagattttctggcagcaccagcggcaacaccgccagcctgacaatctctggactgcaagccgatgacgagggccactacttctgttgggccttcgagaatatcggcggaggcaccaagctgacagtgcttggcggcggaggcggaagtggaggcggaggatctggcggcggaggctctgctggactgatgcagtctggcgctgtgatgaagaacagcggagccagcgtcagagtgtcctgtcaggccgatggctacgatttcatcgactacgtgatccactggttccggcagcggagaggcgaaggacttgaatggctcggctggatgaatccttctggcggcggaacaaactaccccagacctttccagggcaaagtgaccatgaccagagacaccagcaccgagacagcctacctggatgttcggggcctgacctacgatgacaccgccgtgtattactgcgtgcgggacagagccaatggcagtggcaggcggagattcgagagcgtgaactggttcctggacctgtggggcagaggcacccagatcacagtggtttctgctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8709 - DNA, 2592 bp, Artificial Sequence
  Synthetic Polynucleotide encoding a CAR with optional accessory module(s)
atggccttaccagtgaccgccttgctcctgccgctggccttgctgctccacgccgccaggccgcagtctgctctgacccagcctagaagcgtgtcagcctctcctggacagagcgtgaccatcagctgtaccggcacacacaactacgtgtcctggtgccagcagaagcctggacaggctcctaagctgctgatctacgacttcaacaagcggcccagcggcgtgtccgatagattttctggcagcaccagcggcaacaccgccagcctgacaatctctggactgcaagccgatgacgagggccactacttctgttgggccttcgagaatatcggcggaggcaccaagctgacagtgcttggcggcggaggcggaagtggaggcggaggatctggcggcggaggctctgctggactgatgcagtctggcgctgtgatgaagaacagcggagccagcgtcagagtgtcctgtcaggccgatggctacgatttcatcgactacgtgatccactggttccggcagcggagaggcgaaggacttgaatggctcggctggatgaatccttctggcggcggaacaaactaccccagacctttccagggcaaagtgaccatgaccagagacaccagcaccgagacagcctacctggatgttcggggcctgacctacgatgacaccgccgtgtattactgcgtgcgggacagagccaatggcagtggcaggcggagattcgagagcgtgaactggttcctggacctgtggggcagaggcacccagatcacagtggtttctgctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8710 - DNA, 2622 bp, Artificial Sequence
  Synthetic Polynucleotide encoding a CAR with optional accessory module(s)
atggccttaccagtgaccgccttgctcctgccgctggccttgctgctccacgccgccaggccgcagtctgctctgacccagcctagaagcgtgtcagcctctcctggacagagcgtgaccatcagctgtaccggcacacacaactacgtgtcctggtgccagcagaagcctggacaggctcctaagctgctgatctacgacttcaacaagcggcccagcggcgtgtccgatagattttctggcagcaccagcggcaacaccgccagcctgacaatctctggactgcaagccgatgacgagggccactacttctgttgggccttcgagaatatcggcggaggcaccaagctgacagtgcttggcggcggaggcggaagtggaggcggaggatctggcggcggaggctctgctggactgatgcagtctggcgctgtgatgaagaacagcggagccagcgtcagagtgtcctgtcaggccgatggctacgatttcatcgactacgtgatccactggttccggcagcggagaggcgaaggacttgaatggctcggctggatgaatccttctggcggcggaacaaactaccccagacctttccagggcaaagtgaccatgaccagagacaccagcaccgagacagcctacctggatgttcggggcctgacctacgatgacaccgccgtgtattactgcgtgcgggacagagccaatggcagtggcaggcggagattcgagagcgtgaactggttcctggacctgtggggcagaggcacccagatcacagtggtttctgctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8711 - DNA, 2571 bp, Artificial Sequence
  Synthetic Polynucleotide encoding a CAR with optional accessory module(s)
atggccttaccagtgaccgccttgctcctgccgctggccttgctgctccacgccgccaggccgcagtctgctctgacccagcctagaagcgtgtcagcctctcctggacagagcgtgaccatcagctgtaccggcacacacaactacgtgtcctggtgccagcagaagcctggacaggctcctaagctgctgatctacgacttcaacaagcggcccagcggcgtgtccgatagattttctggcagcaccagcggcaacaccgccagcctgacaatctctggactgcaagccgatgacgagggccactacttctgttgggccttcgagaatatcggcggaggcaccaagctgacagtgcttggcggcggaggcggaagtggaggcggaggatctggcggcggaggctctgctggactgatgcagtctggcgctgtgatgaagaacagcggagccagcgtcagagtgtcctgtcaggccgatggctacgatttcatcgactacgtgatccactggttccggcagcggagaggcgaaggacttgaatggctcggctggatgaatccttctggcggcggaacaaactaccccagacctttccagggcaaagtgaccatgaccagagacaccagcaccgagacagcctacctggatgttcggggcctgacctacgatgacaccgccgtgtattactgcgtgcgggacagagccaatggcagtggcaggcggagattcgagagcgtgaactggttcctggacctgtggggcagaggcacccagatcacagtggtttctgctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8712 - DNA, 2547 bp, Artificial Sequence
  Synthetic Polynucleotide encoding a CAR with optional accessory module(s)
atggccttaccagtgaccgccttgctcctgccgctggccttgctgctccacgccgccaggccggctggactgatgcagtctggcgctgtgatgaagaacagcggagccagcgtcagagtgtcctgtcaggccgatggctacgatttcatcgactacgtgatccactggttccggcagcggagaggcgaaggacttgaatggctcggctggatgaatccttctggcggcggaacaaactaccccagacctttccagggcaaagtgaccatgaccagagacaccagcaccgagacagcctacctggatgttcggggcctgacctacgatgacaccgccgtgtattactgcgtgcgggacagagccaatggcagtggcaggcggagattcgagagcgtgaactggttcctggacctgtggggcagaggcacccagatcacagtggtttctgctggcggaggcggaagtggaggcggaggatctggcggcggaggctcttgacagtctgctctgacccagcctagaagcgtgtcagcctctcctggacagagcgtgaccatcagctgtaccggcacacacaactacgtgtcctggtgccagcagaagcctggacaggctcctaagctgctgatctacgacttcaacaagcggcccagcggcgtgtccgatagattttctggcagcaccagcggcaacaccgccagcctgacaatctctggactgcaagccgatgacgagggccactacttctgttgggccttcgagaatatcggcggaggcaccaagctgacagtgcttggcacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccc

SEQ ID NO: 8713 - DNA, 2595 bp, Artificial Sequence
  Synthetic Polynucleotide encoding a CAR with optional accessory module(s)
atggccttaccagtgaccgccttgctcctgccgctggccttgctgctccacgccgccaggccggctggactgatgcagtctggcgctgtgatgaagaacagcggagccagcgtcagagtgtcctgtcaggccgatggctacgatttcatcgactacgtgatccactggttccggcagcggagaggcgaaggacttgaatggctcggctggatgaatccttctggcggcggaacaaactaccccagacctttccagggcaaagtgaccatgaccagagacaccagcaccgagacagcctacctggatgttcggggcctgacctacgatgacaccgccgtgtattactgcgtgcgggacagagccaatggcagtggcaggcggagattcgagagcgtgaactggttcctggacctgtggggcagaggcacccagatcacagtggtttctgctggcggaggcggaagtggaggcggaggatctggcggcggaggctcttgacagtctgctctgacccagcctagaagcgtgtcagcctctcctggacagagcgtgaccatcagctgtaccggcacacacaactacgtgtcctggtgccagcagaagcctggacaggctcctaagctgctgatctacgacttcaacaagcggcccagcggcgtgtccgatagattttctggcagcaccagcggcaacaccgccagcctgacaatctctggactgcaagccgatgacgagggccactacttctgttgggccttcgagaatatcggcggaggcaccaagctgacagtgcttggcacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8714 - DNA, 2625 bp, Artificial Sequence
  Synthetic Polynucleotide encoding a CAR with optional accessory module(s)
atggccttaccagtgaccgccttgctcctgccgctggccttgctgctccacgccgccaggccggctggactgatgcagtctggcgctgtgatgaagaacagcggagccagcgtcagagtgtcctgtcaggccgatggctacgatttcatcgactacgtgatccactggttccggcagcggagaggcgaaggacttgaatggctcggctggatgaatccttctggcggcggaacaaactaccccagacctttccagggcaaagtgaccatgaccagagacaccagcaccgagacagcctacctggatgttcggggcctgacctacgatgacaccgccgtgtattactgcgtgcgggacagagccaatggcagtggcaggcggagattcgagagcgtgaactggttcctggacctgtggggcagaggcacccagatcacagtggtttctgctggcggaggcggaagtggaggcggaggatctggcggcggaggctcttgacagtctgctctgacccagcctagaagcgtgtcagcctctcctggacagagcgtgaccatcagctgtaccggcacacacaactacgtgtcctggtgccagcagaagcctggacaggctcctaagctgctgatctacgacttcaacaagcggcccagcggcgtgtccgatagattttctggcagcaccagcggcaacaccgccagcctgacaatctctggactgcaagccgatgacgagggccactacttctgttgggccttcgagaatatcggcggaggcaccaagctgacagtgcttggcacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8715 - DNA, 2574 bp, Artificial Sequence
  Synthetic Polynucleotide encoding a CAR with optional accessory module(s)
atggccttaccagtgaccgccttgctcctgccgctggccttgctgctccacgccgccaggccggctggactgatgcagtctggcgctgtgatgaagaacagcggagccagcgtcagagtgtcctgtcaggccgatggctacgatttcatcgactacgtgatccactggttccggcagcggagaggcgaaggacttgaatggctcggctggatgaatccttctggcggcggaacaaactaccccagacctttccagggcaaagtgaccatgaccagagacaccagcaccgagacagcctacctggatgttcggggcctgacctacgatgacaccgccgtgtattactgcgtgcgggacagagccaatggcagtggcaggcggagattcgagagcgtgaactggttcctggacctgtggggcagaggcacccagatcacagtggtttctgctggcggaggcggaagtggaggcggaggatctggcggcggaggctcttgacagtctgctctgacccagcctagaagcgtgtcagcctctcctggacagagcgtgaccatcagctgtaccggcacacacaactacgtgtcctggtgccagcagaagcctggacaggctcctaagctgctgatctacgacttcaacaagcggcccagcggcgtgtccgatagattttctggcagcaccagcggcaacaccgccagcctgacaatctctggactgcaagccgatgacgagggccactacttctgttgggccttcgagaatatcggcggaggcaccaagctgacagtgcttggcacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8716 - DNA, 1866 bp, Artificial Sequence
  Synthetic Polynucleotide encoding a CAR with optional accessory module(s)
atggccttaccagtgaccgccttgctcctgccgctggccttgctgctccacgccgccaggccgcagtctgctctgacccagcctagaagcgtgtcagcctctcctggacagagcgtgaccatcagctgtaccggcacacacaactacgtgtcctggtgccagcagaagcctggacaggctcctaagctgctgatctacgacttcaacaagcggcccagcggcgtgtccgatagattttctggcagcaccagcggcaacaccgccagcctgacaatctctggactgcaagccgatgacgagggccactacttctgttgggccttcgagaatatcggcggaggcaccaagctgacagtgcttggcctcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagctggactgatgcagtctggcgctgtgatgaagaacagcggagccagcgtcagagtgtcctgtcaggccgatggctacgatttcatcgactacgtgatccactggttccggcagcggagaggcgaaggacttgaatggctcggctggatgaatccttctggcggcggaacaaactaccccagacctttccagggcaaagtgaccatgaccagagacaccagcaccgagacagcctacctggatgttcggggcctgacctacgatgacaccgccgtgtattactgcgtgcgggacagagccaatggcagtggcaggcggagattcgagagcgtgaactggttcctggacctgtggggcagaggcacccagatcacagtggtttctgctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 8717 - DNA, 1881 bp, Artificial Sequence
  Synthetic Polynucleotide encoding a CAR with optional accessory module(s)
atggccttaccagtgaccgccttgctcctgccgctggccttgctgctccacgccgccaggccgcagtctgctctgacccagcctagaagcgtgtcagcctctcctggacagagcgtgaccatcagctgtaccggcacacacaactacgtgtcctggtgccagcagaagcctggacaggctcctaagctgctgatctacgacttcaacaagcggcccagcggcgtgtccgatagattttctggcagcaccagcggcaacaccgccagcctgacaatctctggactgcaagccgatgacgagggccactacttctgttgggccttcgagaatatcggcggaggcaccaagctgacagtgcttggcctcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagctggactgatgcagtctggcgctgtgatgaagaacagcggagccagcgtcagagtgtcctgtcaggccgatggctacgatttcatcgactacgtgatccactggttccggcagcggagaggcgaaggacttgaatggctcggctggatgaatccttctggcggcggaacaaactaccccagacctttccagggcaaagtgaccatgaccagagacaccagcaccgagacagcctacctggatgttcggggcctgacctacgatgacaccgccgtgtattactgcgtgcgggacagagccaatggcagtggcaggcggagattcgagagcgtgaactggttcctggacctgtggggcagaggcacccagatcacagtggtttctgctacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 8718 - DNA, 1911 bp, Artificial Sequence
  Synthetic Polynucleotide encoding a CAR with optional accessory module(s)
atggccttaccagtgaccgccttgctcctgccgctggccttgctgctccacgccgccaggccgcagtctgctctgacccagcctagaagcgtgtcagcctctcctggacagagcgtgaccatcagctgtaccggcacacacaactacgtgtcctggtgccagcagaagcctggacaggctcctaagctgctgatctacgacttcaacaagcggcccagcggcgtgtccgatagattttctggcagcaccagcggcaacaccgccagcctgacaatctctggactgcaagccgatgacgagggccactacttctgttgggccttcgagaatatcggcggaggcaccaagctgacagtgcttggcctcgagcctggtggcggaggatctcctgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagctggactgatgcagtctggcgctgtgatgaagaacagcggagccagcgtcagagtgtcctgtcaggccgatggctacgatttcatcgactacgtgatccactggttccggcagcggagaggcgaaggacttgaatggctcggctggatgaatccttctggcggcggaacaaactaccccagacctttccagggcaaagtgaccatgaccagagacaccagcaccgagacagcctacctggatgttcggggcctgacctacgatgacaccgccgtgtattactgcgtgcgggacagagccaatggcagtggcaggcggagattcgagagcgtgaactggttcctggacctgtggggcagaggcacccagatcacagtggtttctgctacgcgtcctggcggaggcgggtctcctatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 8719 - DNA, 1908 bp, Artificial Sequence
  Synthetic Polynucleotide encoding a CAR with optional accessory module(s)
atggccttaccagtgaccgccttgctcctgccgctggccttgctgctccacgccgccaggccgcagtctgctctgacccagcctagaagcgtgtcagcctctcctggacagagcgtgaccatcagctgtaccggcacacacaactacgtgtcctggtgccagcagaagcctggacaggctcctaagctgctgatctacgacttcaacaagcggcccagcggcgtgtccgatagattttctggcagcaccagcggcaacaccgccagcctgacaatctctggactgcaagccgatgacgagggccactacttctgttgggccttcgagaatatcggcggaggcaccaagctgacagtgcttggcctcgaggttgcggcgctcgaaagggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagctggactgatgcagtctggcgctgtgatgaagaacagcggagccagcgtcagagtgtcctgtcaggccgatggctacgatttcatcgactacgtgatccactggttccggcagcggagaggcgaaggacttgaatggctcggctggatgaatccttctggcggcggaacaaactaccccagacctttccagggcaaagtgaccatgaccagagacaccagcaccgagacagcctacctggatgttcggggcctgacctacgatgacaccgccgtgtattactgcgtgcgggacagagccaatggcagtggcaggcggagattcgagagcgtgaactggttcctggacctgtggggcagaggcacccagatcacagtggtttctgctacgcgtcgtgtggctgcgctcaaggagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 8720 - DNA, 1896 bp, Artificial Sequence
  Synthetic Polynucleotide encoding a CAR with optional accessory module(s)
atggccttaccagtgaccgccttgctcctgccgctggccttgctgctccacgccgccaggccgcagtctgctctgacccagcctagaagcgtgtcagcctctcctggacagagcgtgaccatcagctgtaccggcacacacaactacgtgtcctggtgccagcagaagcctggacaggctcctaagctgctgatctacgacttcaacaagcggcccagcggcgtgtccgatagattttctggcagcaccagcggcaacaccgccagcctgacaatctctggactgcaagccgatgacgagggccactacttctgttgggccttcgagaatatcggcggaggcaccaagctgacagtgcttggcctcgaggccgcagcaaaggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagctggactgatgcagtctggcgctgtgatgaagaacagcggagccagcgtcagagtgtcctgtcaggccgatggctacgatttcatcgactacgtgatccactggttccggcagcggagaggcgaaggacttgaatggctcggctggatgaatccttctggcggcggaacaaactaccccagacctttccagggcaaagtgaccatgaccagagacaccagcaccgagacagcctacctggatgttcggggcctgacctacgatgacaccgccgtgtattactgcgtgcgggacagagccaatggcagtggcaggcggagattcgagagcgtgaactggttcctggacctgtggggcagaggcacccagatcacagtggtttctgctacgcgtgaagcagccgccaagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 8721 - DNA, 1959 bp, Artificial Sequence
  Synthetic Polynucleotide encoding a CAR with optional accessory module(s)
atggccttaccagtgaccgccttgctcctgccgctggccttgctgctccacgccgccaggccgcagtctgctctgacccagcctagaagcgtgtcagcctctcctggacagagcgtgaccatcagctgtaccggcacacacaactacgtgtcctggtgccagcagaagcctggacaggctcctaagctgctgatctacgacttcaacaagcggcccagcggcgtgtccgatagattttctggcagcaccagcggcaacaccgccagcctgacaatctctggactgcaagccgatgacgagggccactacttctgttgggccttcgagaatatcggcggaggcaccaagctgacagtgcttggcctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagctggactgatgcagtctggcgctgtgatgaagaacagcggagccagcgtcagagtgtcctgtcaggccgatggctacgatttcatcgactacgtgatccactggttccggcagcggagaggcgaaggacttgaatggctcggctggatgaatccttctggcggcggaacaaactaccccagacctttccagggcaaagtgaccatgaccagagacaccagcaccgagacagcctacctggatgttcggggcctgacctacgatgacaccgccgtgtattactgcgtgcgggacagagccaatggcagtggcaggcggagattcgagagcgtgaactggttcctggacctgtggggcagaggcacccagatcacagtggtttctgctacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 8722 - DNA, 3228 bp, Artificial Sequence
  Synthetic Polynucleotide encoding a CAR with optional accessory module(s)
atggccttaccagtgaccgccttgctcctgccgctggccttgctgctccacgccgccaggccgcagtctgctctgacccagcctagaagcgtgtcagcctctcctggacagagcgtgaccatcagctgtaccggcacacacaactacgtgtcctggtgccagcagaagcctggacaggctcctaagctgctgatctacgacttcaacaagcggcccagcggcgtgtccgatagattttctggcagcaccagcggcaacaccgccagcctgacaatctctggactgcaagccgatgacgagggccactacttctgttgggccttcgagaatatcggcggaggcaccaagctgacagtgcttggcctcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagctggactgatgcagtctggcgctgtgatgaagaacagcggagccagcgtcagagtgtcctgtcaggccgatggctacgatttcatcgactacgtgatccactggttccggcagcggagaggcgaaggacttgaatggctcggctggatgaatccttctggcggcggaacaaactaccccagacctttccagggcaaagtgaccatgaccagagacaccagcaccgagacagcctacctggatgttcggggcctgacctacgatgacaccgccgtgtattactgcgtgcgggacagagccaatggcagtggcaggcggagattcgagagcgtgaactggttcctggacctgtggggcagaggcacccagatcacagtggtttctgctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8723 - DNA, 3231 bp, Artificial Sequence
  Synthetic Polynucleotide encoding a CAR with optional accessory module(s)
atggccttaccagtgaccgccttgctcctgccgctggccttgctgctccacgccgccaggccgcagtctgctctgacccagcctagaagcgtgtcagcctctcctggacagagcgtgaccatcagctgtaccggcacacacaactacgtgtcctggtgccagcagaagcctggacaggctcctaagctgctgatctacgacttcaacaagcggcccagcggcgtgtccgatagattttctggcagcaccagcggcaacaccgccagcctgacaatctctggactgcaagccgatgacgagggccactacttctgttgggccttcgagaatatcggcggaggcaccaagctgacagtgcttggcctcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagctggactgatgcagtctggcgctgtgatgaagaacagcggagccagcgtcagagtgtcctgtcaggccgatggctacgatttcatcgactacgtgatccactggttccggcagcggagaggcgaaggacttgaatggctcggctggatgaatccttctggcggcggaacaaactaccccagacctttccagggcaaagtgaccatgaccagagacaccagcaccgagacagcctacctggatgttcggggcctgacctacgatgacaccgccgtgtattactgcgtgcgggacagagccaatggcagtggcaggcggagattcgagagcgtgaactggttcctggacctgtggggcagaggcacccagatcacagtggtttctgctacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8724 - DNA, 3390 bp, Artificial Sequence
  Synthetic Polynucleotide encoding a CAR with optional accessory module(s)
atggccttaccagtgaccgccttgctcctgccgctggccttgctgctccacgccgccaggccgcagtctgctctgacccagcctagaagcgtgtcagcctctcctggacagagcgtgaccatcagctgtaccggcacacacaactacgtgtcctggtgccagcagaagcctggacaggctcctaagctgctgatctacgacttcaacaagcggcccagcggcgtgtccgatagattttctggcagcaccagcggcaacaccgccagcctgacaatctctggactgcaagccgatgacgagggccactacttctgttgggccttcgagaatatcggcggaggcaccaagctgacagtgcttggcctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagctggactgatgcagtctggcgctgtgatgaagaacagcggagccagcgtcagagtgtcctgtcaggccgatggctacgatttcatcgactacgtgatccactggttccggcagcggagaggcgaaggacttgaatggctcggctggatgaatccttctggcggcggaacaaactaccccagacctttccagggcaaagtgaccatgaccagagacaccagcaccgagacagcctacctggatgttcggggcctgacctacgatgacaccgccgtgtattactgcgtgcgggacagagccaatggcagtggcaggcggagattcgagagcgtgaactggttcctggacctgtggggcagaggcacccagatcacagtggtttctgctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 8725 - DNA, 3240 bp, Artificial Sequence
  Synthetic Polynucleotide encoding a CAR with optional accessory module(s)
atggccttaccagtgaccgccttgctcctgccgctggccttgctgctccacgccgccaggccgcagtctgctctgacccagcctagaagcgtgtcagcctctcctggacagagcgtgaccatcagctgtaccggcacacacaactacgtgtcctggtgccagcagaagcctggacaggctcctaagctgctgatctacgacttcaacaagcggcccagcggcgtgtccgatagattttctggcagcaccagcggcaacaccgccagcctgacaatctctggactgcaagccgatgacgagggccactacttctgttgggccttcgagaatatcggcggaggcaccaagctgacagtgcttggcctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagctggactgatgcagtctggcgctgtgatgaagaacagcggagccagcgtcagagtgtcctgtcaggccgatggctacgatttcatcgactacgtgatccactggttccggcagcggagaggcgaaggacttgaatggctcggctggatgaatccttctggcggcggaacaaactaccccagacctttccagggcaaagtgaccatgaccagagacaccagcaccgagacagcctacctggatgttcggggcctgacctacgatgacaccgccgtgtattactgcgtgcgggacagagccaatggcagtggcaggcggagattcgagagcgtgaactggttcctggacctgtggggcagaggcacccagatcacagtggtttctgctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8726 - DNA, 3228 bp, Artificial Sequence
  Synthetic Polynucleotide encoding a CAR with optional accessory module(s)
atggccttaccagtgaccgccttgctcctgccgctggccttgctgctccacgccgccaggccgcagtctgctctgacccagcctagaagcgtgtcagcctctcctggacagagcgtgaccatcagctgtaccggcacacacaactacgtgtcctggtgccagcagaagcctggacaggctcctaagctgctgatctacgacttcaacaagcggcccagcggcgtgtccgatagattttctggcagcaccagcggcaacaccgccagcctgacaatctctggactgcaagccgatgacgagggccactacttctgttgggccttcgagaatatcggcggaggcaccaagctgacagtgcttggcctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagctggactgatgcagtctggcgctgtgatgaagaacagcggagccagcgtcagagtgtcctgtcaggccgatggctacgatttcatcgactacgtgatccactggttccggcagcggagaggcgaaggacttgaatggctcggctggatgaatccttctggcggcggaacaaactaccccagacctttccagggcaaagtgaccatgaccagagacaccagcaccgagacagcctacctggatgttcggggcctgacctacgatgacaccgccgtgtattactgcgtgcgggacagagccaatggcagtggcaggcggagattcgagagcgtgaactggttcctggacctgtggggcagaggcacccagatcacagtggtttctgctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggacgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8727 - DNA, 2679 bp, Artificial Sequence
  Synthetic Polynucleotide encoding a CAR with optional accessory module(s)
atggccttaccagtgaccgccttgctcctgccgctggccttgctgctccacgccgccaggccgcagtctgctctgacccagcctagaagcgtgtcagcctctcctggacagagcgtgaccatcagctgtaccggcacacacaactacgtgtcctggtgccagcagaagcctggacaggctcctaagctgctgatctacgacttcaacaagcggcccagcggcgtgtccgatagattttctggcagcaccagcggcaacaccgccagcctgacaatctctggactgcaagccgatgacgagggccactacttctgttgggccttcgagaatatcggcggaggcaccaagctgacagtgcttggcggcggaggcggaagtggaggcggaggatctggcggcggaggctctgctggactgatgcagtctggcgctgtgatgaagaacagcggagccagcgtcagagtgtcctgtcaggccgatggctacgatttcatcgactacgtgatccactggttccggcagcggagaggcgaaggacttgaatggctcggctggatgaatccttctggcggcggaacaaactaccccagacctttccagggcaaagtgaccatgaccagagacaccagcaccgagacagcctacctggatgttcggggcctgacctacgatgacaccgccgtgtattactgcgtgcgggacagagccaatggcagtggcaggcggagattcgagagcgtgaactggttcctggacctgtggggcagaggcacccagatcacagtggtttctgctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 8728 - DNA, 3711 bp, Artificial Sequence
  Synthetic Polynucleotide encoding a CAR with optional accessory module(s)
atggccttaccagtgaccgccttgctcctgccgctggccttgctgctccacgccgccaggccgcagtctgctctgacccagcctagaagcgtgtcagcctctcctggacagagcgtgaccatcagctgtaccggcacacacaactacgtgtcctggtgccagcagaagcctggacaggctcctaagctgctgatctacgacttcaacaagcggcccagcggcgtgtccgatagattttctggcagcaccagcggcaacaccgccagcctgacaatctctggactgcaagccgatgacgagggccactacttctgttgggccttcgagaatatcggcggaggcaccaagctgacagtgcttggcggcggaggcggaagtggaggcggaggatctggcggcggaggctctgctggactgatgcagtctggcgctgtgatgaagaacagcggagccagcgtcagagtgtcctgtcaggccgatggctacgatttcatcgactacgtgatccactggttccggcagcggagaggcgaaggacttgaatggctcggctggatgaatccttctggcggcggaacaaactaccccagacctttccagggcaaagtgaccatgaccagagacaccagcaccgagacagcctacctggatgttcggggcctgacctacgatgacaccgccgtgtattactgcgtgcgggacagagccaatggcagtggcaggcggagattcgagagcgtgaactggttcctggacctgtggggcagaggcacccagatcacagtggtttctgctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcgagctttgcacagaattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctca

SEQ ID NO: 8729 - DNA, 3231 bp, Artificial Sequence
  Synthetic Polynucleotide encoding a CAR with optional accessory module(s)
atggccttaccagtgaccgccttgctcctgccgctggccttgctgctccacgccgccaggccgcagtctgctctgacccagcctagaagcgtgtcagcctctcctggacagagcgtgaccatcagctgtaccggcacacacaactacgtgtcctggtgccagcagaagcctggacaggctcctaagctgctgatctacgacttcaacaagcggcccagcggcgtgtccgatagattttctggcagcaccagcggcaacaccgccagcctgacaatctctggactgcaagccgatgacgagggccactacttctgttgggccttcgagaatatcggcggaggcaccaagctgacagtgcttggcctcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagctggactgatgcagtctggcgctgtgatgaagaacagcggagccagcgtcagagtgtcctgtcaggccgatggctacgatttcatcgactacgtgatccactggttccggcagcggagaggcgaaggacttgaatggctcggctggatgaatccttctggcggcggaacaaactaccccagacctttccagggcaaagtgaccatgaccagagacaccagcaccgagacagcctacctggatgttcggggcctgacctacgatgacaccgccgtgtattactgcgtgcgggacagagccaatggcagtggcaggcggagattcgagagcgtgaactggttcctggacctgtggggcagaggcacccagatcacagtggtttctgctacgcgtgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8730 - DNA, 4206 bp, Artificial Sequence
  Synthetic Polynucleotide encoding a CAR with optional accessory module(s)
atggccttaccagtgaccgccttgctcctgccgctggccttgctgctccacgccgccaggccgcagtctgctctgacccagcctagaagcgtgtcagcctctcctggacagagcgtgaccatcagctgtaccggcacacacaactacgtgtcctggtgccagcagaagcctggacaggctcctaagctgctgatctacgacttcaacaagcggcccagcggcgtgtccgatagattttctggcagcaccagcggcaacaccgccagcctgacaatctctggactgcaagccgatgacgagggccactacttctgttgggccttcgagaatatcggcggaggcaccaagctgacagtgcttggcctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagctggactgatgcagtctggcgctgtgatgaagaacagcggagccagcgtcagagtgtcctgtcaggccgatggctacgatttcatcgactacgtgatccactggttccggcagcggagaggcgaaggacttgaatggctcggctggatgaatccttctggcggcggaacaaactaccccagacctttccagggcaaagtgaccatgaccagagacaccagcaccgagacagcctacctggatgttcggggcctgacctacgatgacaccgccgtgtattactgcgtgcgggacagagccaatggcagtggcaggcggagattcgagagcgtgaactggttcctggacctgtggggcagaggcacccagatcacagtggtttctgctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggagcggcccccggggctgcggccgggcgcgggcgggccctgggagatgcgggagcggctgggcaccggcggcttcgggaacgtctgtctgtaccagcatcgggaacttgatctcaaaatagcaattaagtcttgtcgcctagagctaagtaccaaaaacagagaacgatggtgccatgaaatccagattatgaagaagttgaaccatgccaatgttgtaaaggcctgtgatgttcctgaagaattgaatattttgattcatgatgtgcctcttctagcaatggaatactgttctggaggagatctccgaaagctgctcaacaaaccagaaaattgttgtggacttaaagaaagccagatactttctttactaagtgatatagggtctgggattcgatatttgcatgaaaacaaaattatacatcgagatctaaaacctgaaaacatagttcttcaggatgttggtggaaagataatacataaaataattgatctgggatatgccaaagatgttgatcaaggagagctgtgtacagagtttgtgggaacactgcagtatctggccccagagctctttgagaataagccttacacagccactgttgattattggagctttgggaccatggtatttgaatgtattgctggatataggccttttttgcatcatctgcagccatttacctggcatgagaagattaagaagaaggatccaaagtgtatatttgcatgtgaagagatgtcaggagaagttcggtttagtagccatttacctcaaccaaatagcctttgtagtttaatagtagaacccatggaaaactggctacagttgatgttgaattgggaccctcagcagagaggaggacctgttgaccttactttgaagcagccaagatgttttgtattaatggatcacattttgaatttgaagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttagaggctgtgatagctatatggtttatttgtttgataaaagtaaaactgtatatgaagggccatttgcttccagaagtttatctgattgtgtaaattatattgtacaggacagcaaaatacagcttccaattatacagctgcgtaaagtgtgggctgaagcagtgcactatgtgtctggactaaaagaagactatagcaggctctttcagggacaaagggcagcaatgttaagtcttcttagatataatgctaacttaacaaaaatgaagaacactttgatctcagcatcacaacaactgaaagctaaattggagttttttcacaaaagcattcagcttgacttggagagatacagcgagcagatgacgtatgggatatcttcagaaaaaatgctaaaagcatggaaagaaatggaagaaaaggccatccactatgctgaggttggtgtcattggatacctggaggatcagattatgtctttgcatgctgaaatcatggggctacagaagagcccctatggaagacgtcagggagacttgatggaatctctggaacagcgtgccattgatctatataagcagttaaaacacagaccttcagatcactcctacagtgacagcacagagatggtgaaaatcattgtgcacactgtgcagagtcaggaccgtgtgctcaaggagctgtttggtcatttgagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtacacagagttctgcccgctctcttgtaggatccagtctagaaggtgcagtaacccctcagacatcagcatggctgcccccgacttcagcagaacatgatcattctctgtcatgtgtggtaactcctcaagatggggagacttcagcacaaatgatagaagaaaatttgaactgccttggccatttaagcactattattcatgaggcaaatgaggaacagggcaatagtatgatgaatcttgattggagttggttaacagaatga

SEQ ID NO: 8731 - DNA, 3204 bp, Artificial Sequence
  Synthetic Polynucleotide encoding a CAR with optional accessory module(s)
atggccttaccagtgaccgccttgctcctgccgctggccttgctgctccacgccgccaggccgcagtctgctctgacccagcctagaagcgtgtcagcctctcctggacagagcgtgaccatcagctgtaccggcacacacaactacgtgtcctggtgccagcagaagcctggacaggctcctaagctgctgatctacgacttcaacaagcggcccagcggcgtgtccgatagattttctggcagcaccagcggcaacaccgccagcctgacaatctctggactgcaagccgatgacgagggccactacttctgttgggccttcgagaatatcggcggaggcaccaagctgacagtgcttggcctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagctggactgatgcagtctggcgctgtgatgaagaacagcggagccagcgtcagagtgtcctgtcaggccgatggctacgatttcatcgactacgtgatccactggttccggcagcggagaggcgaaggacttgaatggctcggctggatgaatccttctggcggcggaacaaactaccccagacctttccagggcaaagtgaccatgaccagagacaccagcaccgagacagcctacctggatgttcggggcctgacctacgatgacaccgccgtgtattactgcgtgcgggacagagccaatggcagtggcaggcggagattcgagagcgtgaactggttcctggacctgtggggcagaggcacccagatcacagtggtttctgctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 8732 - DNA, 2016 bp, Artificial Sequence
  Synthetic Polynucleotide encoding a CAR with optional accessory module(s)
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccgcagtctgctctgacccagcctagaagcgtgtcagcctctcctggacagagcgtgaccatcagctgtaccggcacacacaactacgtgtcctggtgccagcagaagcctggacaggctcctaagctgctgatctacgacttcaacaagcggcccagcggcgtgtccgatagattttctggcagcaccagcggcaacaccgccagcctgacaatctctggactgcaagccgatgacgagggccactacttctgttgggccttcgagaatatcggcggaggcaccaagctgacagtgcttggcggcggaggcggaagtggaggcggaggatctggcggcggaggctctgctggactgatgcagtctggcgctgtgatgaagaacagcggagccagcgtcagagtgtcctgtcaggccgatggctacgatttcatcgactacgtgatccactggttccggcagcggagaggcgaaggacttgaatggctcggctggatgaatccttctggcggcggaacaaactaccccagacctttccagggcaaagtgaccatgaccagagacaccagcaccgagacagcctacctggatgttcggggcctgacctacgatgacaccgccgtgtattactgcgtgcgggacagagccaatggcagtggcaggcggagattcgagagcgtgaactggttcctggacctgtggggcagaggcacccagatcacagtggtttctgctacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 8733 - DNA, 1956 bp, Artificial Sequence
  Synthetic Polynucleotide encoding a CAR with optional accessory module(s)
atggccttaccagtgaccgccttgctcctgccgctggccttgctgctccacgccgccaggccgcagtctgctctgacccagcctagaagcgtgtcagcctctcctggacagagcgtgaccatcagctgtaccggcacacacaactacgtgtcctggtgccagcagaagcctggacaggctcctaagctgctgatctacgacttcaacaagcggcccagcggcgtgtccgatagattttctggcagcaccagcggcaacaccgccagcctgacaatctctggactgcaagccgatgacgagggccactacttctgttgggccttcgagaatatcggcggaggcaccaagctgacagtgcttggcctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagctggactgatgcagtctggcgctgtgatgaagaacagcggagccagcgtcagagtgtcctgtcaggccgatggctacgatttcatcgactacgtgatccactggttccggcagcggagaggcgaaggacttgaatggctcggctggatgaatccttctggcggcggaacaaactaccccagacctttccagggcaaagtgaccatgaccagagacaccagcaccgagacagcctacctggatgttcggggcctgacctacgatgacaccgccgtgtattactgcgtgcgggacagagccaatggcagtggcaggcggagattcgagagcgtgaactggttcctggacctgtggggcagaggcacccagatcacagtggtttctgctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 8734 - DNA, 1866 bp, Artificial Sequence
  Synthetic Polynucleotide encoding a CAR with optional accessory module(s)
atggccttaccagtgaccgccttgctcctgccgctggccttgctgctccacgccgccaggccgcagtctgctctgacccagcctagaagcgtgtcagcctctcctggacagagcgtgaccatcagctgtaccggcacacacaactacgtgtcctggtgccagcagaagcctggacaggctcctaagctgctgatctacgacttcaacaagcggcccagcggcgtgtccgatagattttctggcagcaccagcggcaacaccgccagcctgacaatctctggactgcaagccgatgacgagggccactacttctgttgggccttcgagaatatcggcggaggcaccaagctgacagtgcttggcctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagctggactgatgcagtctggcgctgtgatgaagaacagcggagccagcgtcagagtgtcctgtcaggccgatggctacgatttcatcgactacgtgatccactggttccggcagcggagaggcgaaggacttgaatggctcggctggatgaatccttctggcggcggaacaaactaccccagacctttccagggcaaagtgaccatgaccagagacaccagcaccgagacagcctacctggatgttcggggcctgacctacgatgacaccgccgtgtattactgcgtgcgggacagagccaatggcagtggcaggcggagattcgagagcgtgaactggttcctggacctgtggggcagaggcacccagatcacagtggtttctgctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 8735 - DNA, 2112 bp, Artificial Sequence
  Synthetic Polynucleotide encoding a CAR with optional accessory module(s)
atggccttaccagtgaccgccttgctcctgccgctggccttgctgctccacgccgccaggccgcagtctgctctgacccagcctagaagcgtgtcagcctctcctggacagagcgtgaccatcagctgtaccggcacacacaactacgtgtcctggtgccagcagaagcctggacaggctcctaagctgctgatctacgacttcaacaagcggcccagcggcgtgtccgatagattttctggcagcaccagcggcaacaccgccagcctgacaatctctggactgcaagccgatgacgagggccactacttctgttgggccttcgagaatatcggcggaggcaccaagctgacagtgcttggcctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagctggactgatgcagtctggcgctgtgatgaagaacagcggagccagcgtcagagtgtcctgtcaggccgatggctacgatttcatcgactacgtgatccactggttccggcagcggagaggcgaaggacttgaatggctcggctggatgaatccttctggcggcggaacaaactaccccagacctttccagggcaaagtgaccatgaccagagacaccagcaccgagacagcctacctggatgttcggggcctgacctacgatgacaccgccgtgtattactgcgtgcgggacagagccaatggcagtggcaggcggagattcgagagcgtgaactggttcctggacctgtggggcagaggcacccagatcacagtggtttctgctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 8736 - DNA, 2160 bp, Artificial Sequence
  Synthetic Polynucleotide encoding a CAR with optional accessory module(s)
atggccttaccagtgaccgccttgctcctgccgctggccttgctgctccacgccgccaggccgctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccgcagtctgctctgacccagcctagaagcgtgtcagcctctcctggacagagcgtgaccatcagctgtaccggcacacacaactacgtgtcctggtgccagcagaagcctggacaggctcctaagctgctgatctacgacttcaacaagcggcccagcggcgtgtccgatagattttctggcagcaccagcggcaacaccgccagcctgacaatctctggactgcaagccgatgacgagggccactacttctgttgggccttcgagaatatcggcggaggcaccaagctgacagtgcttggcggcggaggcggaagtggaggcggaggatctggcggcggaggctctgctggactgatgcagtctggcgctgtgatgaagaacagcggagccagcgtcagagtgtcctgtcaggccgatggctacgatttcatcgactacgtgatccactggttccggcagcggagaggcgaaggacttgaatggctcggctggatgaatccttctggcggcggaacaaactaccccagacctttccagggcaaagtgaccatgaccagagacaccagcaccgagacagcctacctggatgttcggggcctgacctacgatgacaccgccgtgtattactgcgtgcgggacagagccaatggcagtggcaggcggagattcgagagcgtgaactggttcctggacctgtggggcagaggcacccagatcacagtggtttctgctacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 8737 - DNA, 1977 bp, Artificial Sequence
  Synthetic Polynucleotide encoding a CAR with optional accessory module(s)
atggccttaccagtgaccgccttgctcctgccgctggccttgctgctccacgccgccaggccgcagtctgctctgacccagcctagaagcgtgtcagcctctcctggacagagcgtgaccatcagctgtaccggcacacacaactacgtgtcctggtgccagcagaagcctggacaggctcctaagctgctgatctacgacttcaacaagcggcccagcggcgtgtccgatagattttctggcagcaccagcggcaacaccgccagcctgacaatctctggactgcaagccgatgacgagggccactacttctgttgggccttcgagaatatcggcggaggcaccaagctgacagtgcttggcctcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagctggactgatgcagtctggcgctgtgatgaagaacagcggagccagcgtcagagtgtcctgtcaggccgatggctacgatttcatcgactacgtgatccactggttccggcagcggagaggcgaaggacttgaatggctcggctggatgaatccttctggcggcggaacaaactaccccagacctttccagggcaaagtgaccatgaccagagacaccagcaccgagacagcctacctggatgttcggggcctgacctacgatgacaccgccgtgtattactgcgtgcgggacagagccaatggcagtggcaggcggagattcgagagcgtgaactggttcctggacctgtggggcagaggcacccagatcacagtggtttctgctacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctc

SEQ ID NO: 8738 - DNA, 1509 bp, Artificial Sequence
  Synthetic Polynucleotide encoding a CAR with optional accessory module(s)
atggccttaccagtgaccgccttgctcctgccgctggccttgctgctccacgccgccaggccgcagtctgctctgacccagcctagaagcgtgtcagcctctcctggacagagcgtgaccatcagctgtaccggcacacacaacctggtgtcctggtgtcagcatcagcctggcagagcccctaagctgctgatctacgacttcaacaagcggcctagcggcgtgcccgatagattttctggatctggctctggcggcaccgccagcctgacaattactggcctccaggacgacgacgatgccgagtatttctgctgggcctacgaagcctttggcggaggcacaaagctgacagtgcttggaggcggaggcggaagtggaggcggaggatctggcggcggaggctctgctgatcttgttcagtctggcgctgtggtcaagaaacccggcgatagcgtgcggatctcttgcgaggctcagggctacagattccccgactacatcatccactggattcggagagccccaggccagggacctgaatggatgggctggatgaatcctatgggcggccaagtgaacatcccctggaagtttcagggcagagtgtccatgaccagagacacctctatcgagactgccttcctggacctgaggggcctgaagtctgatgacaccgccgtgtactactgcgtgcgggacagaagcaatggcagcggcaagagattcgagagcagcaactggttcctggatctgtggggaagaggcaccgctgtgacaatccagtctgctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 8739 - DNA, 1512 bp, Artificial Sequence
  Synthetic Polynucleotide encoding a CAR with optional accessory module(s)
atggccttaccagtgaccgccttgctcctgccgctggccttgctgctccacgccgccaggccggctgatcttgttcagtctggcgctgtggtcaagaaacccggcgatagcgtgcggatctcttgcgaggctcagggctacagattccccgactacatcatccactggattcggagagccccaggccagggacctgaatggatgggctggatgaatcctatgggcggccaagtgaacatcccctggaagtttcagggcagagtgtccatgaccagagacacctctatcgagactgccttcctggacctgaggggcctgaagtctgatgacaccgccgtgtactactgcgtgcgggacagaagcaatggcagcggcaagagattcgagagcagcaactggttcctggatctgtggggaagaggcaccgctgtgacaatccagtctgctggcggaggcggaagtggaggcggaggatctggcggcggaggctcttgacagtctgctctgacccagcctagaagcgtgtcagcctctcctggacagagcgtgaccatcagctgtaccggcacacacaacctggtgtcctggtgtcagcatcagcctggcagagcccctaagctgctgatctacgacttcaacaagcggcctagcggcgtgcccgatagattttctggatctggctctggcggcaccgccagcctgacaattactggcctccaggacgacgacgatgccgagtatttctgctgggcctacgaagcctttggcggaggcacaaagctgacagtgcttggaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 8740 - DNA, 2037 bp, Artificial Sequence
  Synthetic Polynucleotide encoding a CAR with optional accessory module(s)
atggccttaccagtgaccgccttgctcctgccgctggccttgctgctccacgccgccaggccgcagtctgctctgacccagcctagaagcgtgtcagcctctcctggacagagcgtgaccatcagctgtaccggcacacacaacctggtgtcctggtgtcagcatcagcctggcagagcccctaagctgctgatctacgacttcaacaagcggcctagcggcgtgcccgatagattttctggatctggctctggcggcaccgccagcctgacaattactggcctccaggacgacgacgatgccgagtatttctgctgggcctacgaagcctttggcggaggcacaaagctgacagtgcttggaggcggaggcggaagtggaggcggaggatctggcggcggaggctctgctgatcttgttcagtctggcgctgtggtcaagaaacccggcgatagcgtgcggatctcttgcgaggctcagggctacagattccccgactacatcatccactggattcggagagccccaggccagggacctgaatggatgggctggatgaatcctatgggcggccaagtgaacatcccctggaagtttcagggcagagtgtccatgaccagagacacctctatcgagactgccttcctggacctgaggggcctgaagtctgatgacaccgccgtgtactactgcgtgcgggacagaagcaatggcagcggcaagagattcgagagcagcaactggttcctggatctgtggggaagaggcaccgctgtgacaatccagtctgctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccatga

SEQ ID NO: 8741 - DNA, 2730 bp, Artificial Sequence
  Synthetic Polynucleotide encoding a CAR with optional accessory module(s)
atggccttaccagtgaccgccttgctcctgccgctggccttgctgctccacgccgccaggccgcagtctgctctgacccagcctagaagcgtgtcagcctctcctggacagagcgtgaccatcagctgtaccggcacacacaacctggtgtcctggtgtcagcatcagcctggcagagcccctaagctgctgatctacgacttcaacaagcggcctagcggcgtgcccgatagattttctggatctggctctggcggcaccgccagcctgacaattactggcctccaggacgacgacgatgccgagtatttctgctgggcctacgaagcctttggcggaggcacaaagctgacagtgcttggaggcggaggcggaagtggaggcggaggatctggcggcggaggctctgctgatcttgttcagtctggcgctgtggtcaagaaacccggcgatagcgtgcggatctcttgcgaggctcagggctacagattccccgactacatcatccactggattcggagagccccaggccagggacctgaatggatgggctggatgaatcctatgggcggccaagtgaacatcccctggaagtttcagggcagagtgtccatgaccagagacacctctatcgagactgccttcctggacctgaggggcctgaagtctgatgacaccgccgtgtactactgcgtgcgggacagaagcaatggcagcggcaagagattcgagagcagcaactggttcctggatctgtggggaagaggcaccgctgtgacaatccagtctgctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8742 - DNA, 2694 bp, Artificial Sequence
  Synthetic Polynucleotide encoding a CAR with optional accessory module(s)
atggccttaccagtgaccgccttgctcctgccgctggccttgctgctccacgccgccaggccgcagtctgctctgacccagcctagaagcgtgtcagcctctcctggacagagcgtgaccatcagctgtaccggcacacacaacctggtgtcctggtgtcagcatcagcctggcagagcccctaagctgctgatctacgacttcaacaagcggcctagcggcgtgcccgatagattttctggatctggctctggcggcaccgccagcctgacaattactggcctccaggacgacgacgatgccgagtatttctgctgggcctacgaagcctttggcggaggcacaaagctgacagtgcttggaggcggaggcggaagtggaggcggaggatctggcggcggaggctctgctgatcttgttcagtctggcgctgtggtcaagaaacccggcgatagcgtgcggatctcttgcgaggctcagggctacagattccccgactacatcatccactggattcggagagccccaggccagggacctgaatggatgggctggatgaatcctatgggcggccaagtgaacatcccctggaagtttcagggcagagtgtccatgaccagagacacctctatcgagactgccttcctggacctgaggggcctgaagtctgatgacaccgccgtgtactactgcgtgcgggacagaagcaatggcagcggcaagagattcgagagcagcaactggttcctggatctgtggggaagaggcaccgctgtgacaatccagtctgctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8743 - DNA, 2589 bp, Artificial Sequence
  Synthetic Polynucleotide encoding a CAR with optional accessory module(s)
atggccttaccagtgaccgccttgctcctgccgctggccttgctgctccacgccgccaggccgcagtctgctctgacccagcctagaagcgtgtcagcctctcctggacagagcgtgaccatcagctgtaccggcacacacaacctggtgtcctggtgtcagcatcagcctggcagagcccctaagctgctgatctacgacttcaacaagcggcctagcggcgtgcccgatagattttctggatctggctctggcggcaccgccagcctgacaattactggcctccaggacgacgacgatgccgagtatttctgctgggcctacgaagcctttggcggaggcacaaagctgacagtgcttggaggcggaggcggaagtggaggcggaggatctggcggcggaggctctgctgatcttgttcagtctggcgctgtggtcaagaaacccggcgatagcgtgcggatctcttgcgaggctcagggctacagattccccgactacatcatccactggattcggagagccccaggccagggacctgaatggatgggctggatgaatcctatgggcggccaagtgaacatcccctggaagtttcagggcagagtgtccatgaccagagacacctctatcgagactgccttcctggacctgaggggcctgaagtctgatgacaccgccgtgtactactgcgtgcgggacagaagcaatggcagcggcaagagattcgagagcagcaactggttcctggatctgtggggaagaggcaccgctgtgacaatccagtctgctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8744 - DNA, 2619 bp, Artificial Sequence
  Synthetic Polynucleotide encoding a CAR with optional accessory module(s)
atggccttaccagtgaccgccttgctcctgccgctggccttgctgctccacgccgccaggccgcagtctgctctgacccagcctagaagcgtgtcagcctctcctggacagagcgtgaccatcagctgtaccggcacacacaacctggtgtcctggtgtcagcatcagcctggcagagcccctaagctgctgatctacgacttcaacaagcggcctagcggcgtgcccgatagattttctggatctggctctggcggcaccgccagcctgacaattactggcctccaggacgacgacgatgccgagtatttctgctgggcctacgaagcctttggcggaggcacaaagctgacagtgcttggaggcggaggcggaagtggaggcggaggatctggcggcggaggctctgctgatcttgttcagtctggcgctgtggtcaagaaacccggcgatagcgtgcggatctcttgcgaggctcagggctacagattccccgactacatcatccactggattcggagagccccaggccagggacctgaatggatgggctggatgaatcctatgggcggccaagtgaacatcccctggaagtttcagggcagagtgtccatgaccagagacacctctatcgagactgccttcctggacctgaggggcctgaagtctgatgacaccgccgtgtactactgcgtgcgggacagaagcaatggcagcggcaagagattcgagagcagcaactggttcctggatctgtggggaagaggcaccgctgtgacaatccagtctgctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8745 - DNA, 2568 bp, Artificial Sequence
  Synthetic Polynucleotide encoding a CAR with optional accessory module(s)
atggccttaccagtgaccgccttgctcctgccgctggccttgctgctccacgccgccaggccgcagtctgctctgacccagcctagaagcgtgtcagcctctcctggacagagcgtgaccatcagctgtaccggcacacacaacctggtgtcctggtgtcagcatcagcctggcagagcccctaagctgctgatctacgacttcaacaagcggcctagcggcgtgcccgatagattttctggatctggctctggcggcaccgccagcctgacaattactggcctccaggacgacgacgatgccgagtatttctgctgggcctacgaagcctttggcggaggcacaaagctgacagtgcttggaggcggaggcggaagtggaggcggaggatctggcggcggaggctctgctgatcttgttcagtctggcgctgtggtcaagaaacccggcgatagcgtgcggatctcttgcgaggctcagggctacagattccccgactacatcatccactggattcggagagccccaggccagggacctgaatggatgggctggatgaatcctatgggcggccaagtgaacatcccctggaagtttcagggcagagtgtccatgaccagagacacctctatcgagactgccttcctggacctgaggggcctgaagtctgatgacaccgccgtgtactactgcgtgcgggacagaagcaatggcagcggcaagagattcgagagcagcaactggttcctggatctgtggggaagaggcaccgctgtgacaatccagtctgctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8746 - DNA, 2544 bp, Artificial Sequence
  Synthetic Polynucleotide encoding a CAR with optional accessory module(s)
atggccttaccagtgaccgccttgctcctgccgctggccttgctgctccacgccgccaggccggctgatcttgttcagtctggcgctgtggtcaagaaacccggcgatagcgtgcggatctcttgcgaggctcagggctacagattccccgactacatcatccactggattcggagagccccaggccagggacctgaatggatgggctggatgaatcctatgggcggccaagtgaacatcccctggaagtttcagggcagagtgtccatgaccagagacacctctatcgagactgccttcctggacctgaggggcctgaagtctgatgacaccgccgtgtactactgcgtgcgggacagaagcaatggcagcggcaagagattcgagagcagcaactggttcctggatctgtggggaagaggcaccgctgtgacaatccagtctgctggcggaggcggaagtggaggcggaggatctggcggcggaggctcttgacagtctgctctgacccagcctagaagcgtgtcagcctctcctggacagagcgtgaccatcagctgtaccggcacacacaacctggtgtcctggtgtcagcatcagcctggcagagcccctaagctgctgatctacgacttcaacaagcggcctagcggcgtgcccgatagattttctggatctggctctggcggcaccgccagcctgacaattactggcctccaggacgacgacgatgccgagtatttctgctgggcctacgaagcctttggcggaggcacaaagctgacagtgcttggaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccc

SEQ ID NO: 8747 - DNA, 2592 bp, Artificial Sequence
  Synthetic Polynucleotide encoding a CAR with optional accessory module(s)
atggccttaccagtgaccgccttgctcctgccgctggccttgctgctccacgccgccaggccggctgatcttgttcagtctggcgctgtggtcaagaaacccggcgatagcgtgcggatctcttgcgaggctcagggctacagattccccgactacatcatccactggattcggagagccccaggccagggacctgaatggatgggctggatgaatcctatgggcggccaagtgaacatcccctggaagtttcagggcagagtgtccatgaccagagacacctctatcgagactgccttcctggacctgaggggcctgaagtctgatgacaccgccgtgtactactgcgtgcgggacagaagcaatggcagcggcaagagattcgagagcagcaactggttcctggatctgtggggaagaggcaccgctgtgacaatccagtctgctggcggaggcggaagtggaggcggaggatctggcggcggaggctcttgacagtctgctctgacccagcctagaagcgtgtcagcctctcctggacagagcgtgaccatcagctgtaccggcacacacaacctggtgtcctggtgtcagcatcagcctggcagagcccctaagctgctgatctacgacttcaacaagcggcctagcggcgtgcccgatagattttctggatctggctctggcggcaccgccagcctgacaattactggcctccaggacgacgacgatgccgagtatttctgctgggcctacgaagcctttggcggaggcacaaagctgacagtgcttggaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8748 - DNA, 2622 bp, Artificial Sequence
  Synthetic Polynucleotide encoding a CAR with optional accessory module(s)
atggccttaccagtgaccgccttgctcctgccgctggccttgctgctccacgccgccaggccggctgatcttgttcagtctggcgctgtggtcaagaaacccggcgatagcgtgcggatctcttgcgaggctcagggctacagattccccgactacatcatccactggattcggagagccccaggccagggacctgaatggatgggctggatgaatcctatgggcggccaagtgaacatcccctggaagtttcagggcagagtgtccatgaccagagacacctctatcgagactgccttcctggacctgaggggcctgaagtctgatgacaccgccgtgtactactgcgtgcgggacagaagcaatggcagcggcaagagattcgagagcagcaactggttcctggatctgtggggaagaggcaccgctgtgacaatccagtctgctggcggaggcggaagtggaggcggaggatctggcggcggaggctcttgacagtctgctctgacccagcctagaagcgtgtcagcctctcctggacagagcgtgaccatcagctgtaccggcacacacaacctggtgtcctggtgtcagcatcagcctggcagagcccctaagctgctgatctacgacttcaacaagcggcctagcggcgtgcccgatagattttctggatctggctctggcggcaccgccagcctgacaattactggcctccaggacgacgacgatgccgagtatttctgctgggcctacgaagcctttggcggaggcacaaagctgacagtgcttggaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8749 - DNA, 2571 bp, Artificial Sequence
  Synthetic Polynucleotide encoding a CAR with optional accessory module(s)
atggccttaccagtgaccgccttgctcctgccgctggccttgctgctccacgccgccaggccggctgatcttgttcagtctggcgctgtggtcaagaaacccggcgatagcgtgcggatctcttgcgaggctcagggctacagattccccgactacatcatccactggattcggagagccccaggccagggacctgaatggatgggctggatgaatcctatgggcggccaagtgaacatcccctggaagtttcagggcagagtgtccatgaccagagacacctctatcgagactgccttcctggacctgaggggcctgaagtctgatgacaccgccgtgtactactgcgtgcgggacagaagcaatggcagcggcaagagattcgagagcagcaactggttcctggatctgtggggaagaggcaccgctgtgacaatccagtctgctggcggaggcggaagtggaggcggaggatctggcggcggaggctcttgacagtctgctctgacccagcctagaagcgtgtcagcctctcctggacagagcgtgaccatcagctgtaccggcacacacaacctggtgtcctggtgtcagcatcagcctggcagagcccctaagctgctgatctacgacttcaacaagcggcctagcggcgtgcccgatagattttctggatctggctctggcggcaccgccagcctgacaattactggcctccaggacgacgacgatgccgagtatttctgctgggcctacgaagcctttggcggaggcacaaagctgacagtgcttggaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8750 - DNA, 1863 bp, Artificial Sequence
  Synthetic Polynucleotide encoding a CAR with optional accessory module(s)
atggccttaccagtgaccgccttgctcctgccgctggccttgctgctccacgccgccaggccgcagtctgctctgacccagcctagaagcgtgtcagcctctcctggacagagcgtgaccatcagctgtaccggcacacacaacctggtgtcctggtgtcagcatcagcctggcagagcccctaagctgctgatctacgacttcaacaagcggcctagcggcgtgcccgatagattttctggatctggctctggcggcaccgccagcctgacaattactggcctccaggacgacgacgatgccgagtatttctgctgggcctacgaagcctttggcggaggcacaaagctgacagtgcttggactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagctgatcttgttcagtctggcgctgtggtcaagaaacccggcgatagcgtgcggatctcttgcgaggctcagggctacagattccccgactacatcatccactggattcggagagccccaggccagggacctgaatggatgggctggatgaatcctatgggcggccaagtgaacatcccctggaagtttcagggcagagtgtccatgaccagagacacctctatcgagactgccttcctggacctgaggggcctgaagtctgatgacaccgccgtgtactactgcgtgcgggacagaagcaatggcagcggcaagagattcgagagcagcaactggttcctggatctgtggggaagaggcaccgctgtgacaatccagtctgctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 8751 - DNA, 1878 bp, Artificial Sequence
  Synthetic Polynucleotide encoding a CAR with optional accessory module(s)
atggccttaccagtgaccgccttgctcctgccgctggccttgctgctccacgccgccaggccgcagtctgctctgacccagcctagaagcgtgtcagcctctcctggacagagcgtgaccatcagctgtaccggcacacacaacctggtgtcctggtgtcagcatcagcctggcagagcccctaagctgctgatctacgacttcaacaagcggcctagcggcgtgcccgatagattttctggatctggctctggcggcaccgccagcctgacaattactggcctccaggacgacgacgatgccgagtatttctgctgggcctacgaagcctttggcggaggcacaaagctgacagtgcttggactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagctgatcttgttcagtctggcgctgtggtcaagaaacccggcgatagcgtgcggatctcttgcgaggctcagggctacagattccccgactacatcatccactggattcggagagccccaggccagggacctgaatggatgggctggatgaatcctatgggcggccaagtgaacatcccctggaagtttcagggcagagtgtccatgaccagagacacctctatcgagactgccttcctggacctgaggggcctgaagtctgatgacaccgccgtgtactactgcgtgcgggacagaagcaatggcagcggcaagagattcgagagcagcaactggttcctggatctgtggggaagaggcaccgctgtgacaatccagtctgctacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 8752 - DNA, 1908 bp, Artificial Sequence
  Synthetic Polynucleotide encoding a CAR with optional accessory module(s)
atggccttaccagtgaccgccttgctcctgccgctggccttgctgctccacgccgccaggccgcagtctgctctgacccagcctagaagcgtgtcagcctctcctggacagagcgtgaccatcagctgtaccggcacacacaacctggtgtcctggtgtcagcatcagcctggcagagcccctaagctgctgatctacgacttcaacaagcggcctagcggcgtgcccgatagattttctggatctggctctggcggcaccgccagcctgacaattactggcctccaggacgacgacgatgccgagtatttctgctgggcctacgaagcctttggcggaggcacaaagctgacagtgcttggactcgagcctggtggcggaggatctcctgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagctgatcttgttcagtctggcgctgtggtcaagaaacccggcgatagcgtgcggatctcttgcgaggctcagggctacagattccccgactacatcatccactggattcggagagccccaggccagggacctgaatggatgggctggatgaatcctatgggcggccaagtgaacatcccctggaagtttcagggcagagtgtccatgaccagagacacctctatcgagactgccttcctggacctgaggggcctgaagtctgatgacaccgccgtgtactactgcgtgcgggacagaagcaatggcagcggcaagagattcgagagcagcaactggttcctggatctgtggggaagaggcaccgctgtgacaatccagtctgctacgcgtcctggcggaggcgggtctcctatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 8753 - DNA, 1905 bp, Artificial Sequence
  Synthetic Polynucleotide encoding a CAR with optional accessory module(s)
atggccttaccagtgaccgccttgctcctgccgctggccttgctgctccacgccgccaggccgcagtctgctctgacccagcctagaagcgtgtcagcctctcctggacagagcgtgaccatcagctgtaccggcacacacaacctggtgtcctggtgtcagcatcagcctggcagagcccctaagctgctgatctacgacttcaacaagcggcctagcggcgtgcccgatagattttctggatctggctctggcggcaccgccagcctgacaattactggcctccaggacgacgacgatgccgagtatttctgctgggcctacgaagcctttggcggaggcacaaagctgacagtgcttggactcgaggttgcggcgctcgaaagggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagctgatcttgttcagtctggcgctgtggtcaagaaacccggcgatagcgtgcggatctcttgcgaggctcagggctacagattccccgactacatcatccactggattcggagagccccaggccagggacctgaatggatgggctggatgaatcctatgggcggccaagtgaacatcccctggaagtttcagggcagagtgtccatgaccagagacacctctatcgagactgccttcctggacctgaggggcctgaagtctgatgacaccgccgtgtactactgcgtgcgggacagaagcaatggcagcggcaagagattcgagagcagcaactggttcctggatctgtggggaagaggcaccgctgtgacaatccagtctgctacgcgtcgtgtggctgcgctcaaggagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 8754 - DNA, 1893 bp, Artificial Sequence
  Synthetic Polynucleotide encoding a CAR with optional accessory module(s)
atggccttaccagtgaccgccttgctcctgccgctggccttgctgctccacgccgccaggccgcagtctgctctgacccagcctagaagcgtgtcagcctctcctggacagagcgtgaccatcagctgtaccggcacacacaacctggtgtcctggtgtcagcatcagcctggcagagcccctaagctgctgatctacgacttcaacaagcggcctagcggcgtgcccgatagattttctggatctggctctggcggcaccgccagcctgacaattactggcctccaggacgacgacgatgccgagtatttctgctgggcctacgaagcctttggcggaggcacaaagctgacagtgcttggactcgaggccgcagcaaaggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagctgatcttgttcagtctggcgctgtggtcaagaaacccggcgatagcgtgcggatctcttgcgaggctcagggctacagattccccgactacatcatccactggattcggagagccccaggccagggacctgaatggatgggctggatgaatcctatgggcggccaagtgaacatcccctggaagtttcagggcagagtgtccatgaccagagacacctctatcgagactgccttcctggacctgaggggcctgaagtctgatgacaccgccgtgtactactgcgtgcgggacagaagcaatggcagcggcaagagattcgagagcagcaactggttcctggatctgtggggaagaggcaccgctgtgacaatccagtctgctacgcgtgaagcagccgccaagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 8755 - DNA, 1956 bp, Artificial Sequence
  Synthetic Polynucleotide encoding a CAR with optional accessory module(s)
atggccttaccagtgaccgccttgctcctgccgctggccttgctgctccacgccgccaggccgcagtctgctctgacccagcctagaagcgtgtcagcctctcctggacagagcgtgaccatcagctgtaccggcacacacaacctggtgtcctggtgtcagcatcagcctggcagagcccctaagctgctgatctacgacttcaacaagcggcctagcggcgtgcccgatagattttctggatctggctctggcggcaccgccagcctgacaattactggcctccaggacgacgacgatgccgagtatttctgctgggcctacgaagcctttggcggaggcacaaagctgacagtgcttggactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagctgatcttgttcagtctggcgctgtggtcaagaaacccggcgatagcgtgcggatctcttgcgaggctcagggctacagattccccgactacatcatccactggattcggagagccccaggccagggacctgaatggatgggctggatgaatcctatgggcggccaagtgaacatcccctggaagtttcagggcagagtgtccatgaccagagacacctctatcgagactgccttcctggacctgaggggcctgaagtctgatgacaccgccgtgtactactgcgtgcgggacagaagcaatggcagcggcaagagattcgagagcagcaactggttcctggatctgtggggaagaggcaccgctgtgacaatccagtctgctacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 8756 - DNA, 3225 bp, Artificial Sequence
  Synthetic Polynucleotide encoding a CAR with optional accessory module(s)
atggccttaccagtgaccgccttgctcctgccgctggccttgctgctccacgccgccaggccgcagtctgctctgacccagcctagaagcgtgtcagcctctcctggacagagcgtgaccatcagctgtaccggcacacacaacctggtgtcctggtgtcagcatcagcctggcagagcccctaagctgctgatctacgacttcaacaagcggcctagcggcgtgcccgatagattttctggatctggctctggcggcaccgccagcctgacaattactggcctccaggacgacgacgatgccgagtatttctgctgggcctacgaagcctttggcggaggcacaaagctgacagtgcttggactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagctgatcttgttcagtctggcgctgtggtcaagaaacccggcgatagcgtgcggatctcttgcgaggctcagggctacagattccccgactacatcatccactggattcggagagccccaggccagggacctgaatggatgggctggatgaatcctatgggcggccaagtgaacatcccctggaagtttcagggcagagtgtccatgaccagagacacctctatcgagactgccttcctggacctgaggggcctgaagtctgatgacaccgccgtgtactactgcgtgcgggacagaagcaatggcagcggcaagagattcgagagcagcaactggttcctggatctgtggggaagaggcaccgctgtgacaatccagtctgctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8757 - DNA, 3228 bp, Artificial Sequence
  Synthetic Polynucleotide encoding a CAR with optional accessory module(s)
atggccttaccagtgaccgccttgctcctgccgctggccttgctgctccacgccgccaggccgcagtctgctctgacccagcctagaagcgtgtcagcctctcctggacagagcgtgaccatcagctgtaccggcacacacaacctggtgtcctggtgtcagcatcagcctggcagagcccctaagctgctgatctacgacttcaacaagcggcctagcggcgtgcccgatagattttctggatctggctctggcggcaccgccagcctgacaattactggcctccaggacgacgacgatgccgagtatttctgctgggcctacgaagcctttggcggaggcacaaagctgacagtgcttggactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagctgatcttgttcagtctggcgctgtggtcaagaaacccggcgatagcgtgcggatctcttgcgaggctcagggctacagattccccgactacatcatccactggattcggagagccccaggccagggacctgaatggatgggctggatgaatcctatgggcggccaagtgaacatcccctggaagtttcagggcagagtgtccatgaccagagacacctctatcgagactgccttcctggacctgaggggcctgaagtctgatgacaccgccgtgtactactgcgtgcgggacagaagcaatggcagcggcaagagattcgagagcagcaactggttcctggatctgtggggaagaggcaccgctgtgacaatccagtctgctacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8758 - DNA, 3387 bp, Artificial Sequence
  Synthetic Polynucleotide encoding a CAR with optional accessory module(s)
atggccttaccagtgaccgccttgctcctgccgctggccttgctgctccacgccgccaggccgcagtctgctctgacccagcctagaagcgtgtcagcctctcctggacagagcgtgaccatcagctgtaccggcacacacaacctggtgtcctggtgtcagcatcagcctggcagagcccctaagctgctgatctacgacttcaacaagcggcctagcggcgtgcccgatagattttctggatctggctctggcggcaccgccagcctgacaattactggcctccaggacgacgacgatgccgagtatttctgctgggcctacgaagcctttggcggaggcacaaagctgacagtgcttggactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagctgatcttgttcagtctggcgctgtggtcaagaaacccggcgatagcgtgcggatctcttgcgaggctcagggctacagattccccgactacatcatccactggattcggagagccccaggccagggacctgaatggatgggctggatgaatcctatgggcggccaagtgaacatcccctggaagtttcagggcagagtgtccatgaccagagacacctctatcgagactgccttcctggacctgaggggcctgaagtctgatgacaccgccgtgtactactgcgtgcgggacagaagcaatggcagcggcaagagattcgagagcagcaactggttcctggatctgtggggaagaggcaccgctgtgacaatccagtctgctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 8759 - DNA, 3237 bp, Artificial Sequence
  Synthetic Polynucleotide encoding a CAR with optional accessory module(s)
atggccttaccagtgaccgccttgctcctgccgctggccttgctgctccacgccgccaggccgcagtctgctctgacccagcctagaagcgtgtcagcctctcctggacagagcgtgaccatcagctgtaccggcacacacaacctggtgtcctggtgtcagcatcagcctggcagagcccctaagctgctgatctacgacttcaacaagcggcctagcggcgtgcccgatagattttctggatctggctctggcggcaccgccagcctgacaattactggcctccaggacgacgacgatgccgagtatttctgctgggcctacgaagcctttggcggaggcacaaagctgacagtgcttggactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagctgatcttgttcagtctggcgctgtggtcaagaaacccggcgatagcgtgcggatctcttgcgaggctcagggctacagattccccgactacatcatccactggattcggagagccccaggccagggacctgaatggatgggctggatgaatcctatgggcggccaagtgaacatcccctggaagtttcagggcagagtgtccatgaccagagacacctctatcgagactgccttcctggacctgaggggcctgaagtctgatgacaccgccgtgtactactgcgtgcgggacagaagcaatggcagcggcaagagattcgagagcagcaactggttcctggatctgtggggaagaggcaccgctgtgacaatccagtctgctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8760 - DNA, 3225 bp, Artificial Sequence
  Synthetic Polynucleotide encoding a CAR with optional accessory module(s)
atggccttaccagtgaccgccttgctcctgccgctggccttgctgctccacgccgccaggccgcagtctgctctgacccagcctagaagcgtgtcagcctctcctggacagagcgtgaccatcagctgtaccggcacacacaacctggtgtcctggtgtcagcatcagcctggcagagcccctaagctgctgatctacgacttcaacaagcggcctagcggcgtgcccgatagattttctggatctggctctggcggcaccgccagcctgacaattactggcctccaggacgacgacgatgccgagtatttctgctgggcctacgaagcctttggcggaggcacaaagctgacagtgcttggactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagctgatcttgttcagtctggcgctgtggtcaagaaacccggcgatagcgtgcggatctcttgcgaggctcagggctacagattccccgactacatcatccactggattcggagagccccaggccagggacctgaatggatgggctggatgaatcctatgggcggccaagtgaacatcccctggaagtttcagggcagagtgtccatgaccagagacacctctatcgagactgccttcctggacctgaggggcctgaagtctgatgacaccgccgtgtactactgcgtgcgggacagaagcaatggcagcggcaagagattcgagagcagcaactggttcctggatctgtggggaagaggcaccgctgtgacaatccagtctgctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggacgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8761 - DNA, 2676 bp, Artificial Sequence
  Synthetic Polynucleotide encoding a CAR with optional accessory module(s)
atggccttaccagtgaccgccttgctcctgccgctggccttgctgctccacgccgccaggccgcagtctgctctgacccagcctagaagcgtgtcagcctctcctggacagagcgtgaccatcagctgtaccggcacacacaacctggtgtcctggtgtcagcatcagcctggcagagcccctaagctgctgatctacgacttcaacaagcggcctagcggcgtgcccgatagattttctggatctggctctggcggcaccgccagcctgacaattactggcctccaggacgacgacgatgccgagtatttctgctgggcctacgaagcctttggcggaggcacaaagctgacagtgcttggaggcggaggcggaagtggaggcggaggatctggcggcggaggctctgctgatcttgttcagtctggcgctgtggtcaagaaacccggcgatagcgtgcggatctcttgcgaggctcagggctacagattccccgactacatcatccactggattcggagagccccaggccagggacctgaatggatgggctggatgaatcctatgggcggccaagtgaacatcccctggaagtttcagggcagagtgtccatgaccagagacacctctatcgagactgccttcctggacctgaggggcctgaagtctgatgacaccgccgtgtactactgcgtgcgggacagaagcaatggcagcggcaagagattcgagagcagcaactggttcctggatctgtggggaagaggcaccgctgtgacaatccagtctgctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 8762 - DNA, 3708 bp, Artificial Sequence
  Synthetic Polynucleotide encoding a CAR with optional accessory module(s)
atggccttaccagtgaccgccttgctcctgccgctggccttgctgctccacgccgccaggccgcagtctgctctgacccagcctagaagcgtgtcagcctctcctggacagagcgtgaccatcagctgtaccggcacacacaacctggtgtcctggtgtcagcatcagcctggcagagcccctaagctgctgatctacgacttcaacaagcggcctagcggcgtgcccgatagattttctggatctggctctggcggcaccgccagcctgacaattactggcctccaggacgacgacgatgccgagtatttctgctgggcctacgaagcctttggcggaggcacaaagctgacagtgcttggaggcggaggcggaagtggaggcggaggatctggcggcggaggctctgctgatcttgttcagtctggcgctgtggtcaagaaacccggcgatagcgtgcggatctcttgcgaggctcagggctacagattccccgactacatcatccactggattcggagagccccaggccagggacctgaatggatgggctggatgaatcctatgggcggccaagtgaacatcccctggaagtttcagggcagagtgtccatgaccagagacacctctatcgagactgccttcctggacctgaggggcctgaagtctgatgacaccgccgtgtactactgcgtgcgggacagaagcaatggcagcggcaagagattcgagagcagcaactggttcctggatctgtggggaagaggcaccgctgtgacaatccagtctgctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcgagctttgcacagaattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctca

SEQ ID NO: 8763 - DNA, 3228 bp, Artificial Sequence
  Synthetic Polynucleotide encoding a CAR with optional accessory module(s)
atggccttaccagtgaccgccttgctcctgccgctggccttgctgctccacgccgccaggccgcagtctgctctgacccagcctagaagcgtgtcagcctctcctggacagagcgtgaccatcagctgtaccggcacacacaacctggtgtcctggtgtcagcatcagcctggcagagcccctaagctgctgatctacgacttcaacaagcggcctagcggcgtgcccgatagattttctggatctggctctggcggcaccgccagcctgacaattactggcctccaggacgacgacgatgccgagtatttctgctgggcctacgaagcctttggcggaggcacaaagctgacagtgcttggactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagctgatcttgttcagtctggcgctgtggtcaagaaacccggcgatagcgtgcggatctcttgcgaggctcagggctacagattccccgactacatcatccactggattcggagagccccaggccagggacctgaatggatgggctggatgaatcctatgggcggccaagtgaacatcccctggaagtttcagggcagagtgtccatgaccagagacacctctatcgagactgccttcctggacctgaggggcctgaagtctgatgacaccgccgtgtactactgcgtgcgggacagaagcaatggcagcggcaagagattcgagagcagcaactggttcctggatctgtggggaagaggcaccgctgtgacaatccagtctgctacgcgtgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8764 - DNA, 4203 bp, Artificial Sequence
  Synthetic Polynucleotide encoding a CAR with optional accessory module(s)
atggccttaccagtgaccgccttgctcctgccgctggccttgctgctccacgccgccaggccgcagtctgctctgacccagcctagaagcgtgtcagcctctcctggacagagcgtgaccatcagctgtaccggcacacacaacctggtgtcctggtgtcagcatcagcctggcagagcccctaagctgctgatctacgacttcaacaagcggcctagcggcgtgcccgatagattttctggatctggctctggcggcaccgccagcctgacaattactggcctccaggacgacgacgatgccgagtatttctgctgggcctacgaagcctttggcggaggcacaaagctgacagtgcttggactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagctgatcttgttcagtctggcgctgtggtcaagaaacccggcgatagcgtgcggatctcttgcgaggctcagggctacagattccccgactacatcatccactggattcggagagccccaggccagggacctgaatggatgggctggatgaatcctatgggcggccaagtgaacatcccctggaagtttcagggcagagtgtccatgaccagagacacctctatcgagactgccttcctggacctgaggggcctgaagtctgatgacaccgccgtgtactactgcgtgcgggacagaagcaatggcagcggcaagagattcgagagcagcaactggttcctggatctgtggggaagaggcaccgctgtgacaatccagtctgctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggagcggcccccggggctgcggccgggcgcgggcgggccctgggagatgcgggagcggctgggcaccggcggcttcgggaacgtctgtctgtaccagcatcgggaacttgatctcaaaatagcaattaagtcttgtcgcctagagctaagtaccaaaaacagagaacgatggtgccatgaaatccagattatgaagaagttgaaccatgccaatgttgtaaaggcctgtgatgttcctgaagaattgaatattttgattcatgatgtgcctcttctagcaatggaatactgttctggaggagatctccgaaagctgctcaacaaaccagaaaattgttgtggacttaaagaaagccagatactttctttactaagtgatatagggtctgggattcgatatttgcatgaaaacaaaattatacatcgagatctaaaacctgaaaacatagttcttcaggatgttggtggaaagataatacataaaataattgatctgggatatgccaaagatgttgatcaaggagagctgtgtacagagtttgtgggaacactgcagtatctggccccagagctctttgagaataagccttacacagccactgttgattattggagctttgggaccatggtatttgaatgtattgctggatataggccttttttgcatcatctgcagccatttacctggcatgagaagattaagaagaaggatccaaagtgtatatttgcatgtgaagagatgtcaggagaagttcggtttagtagccatttacctcaaccaaatagcctttgtagtttaatagtagaacccatggaaaactggctacagttgatgttgaattgggaccctcagcagagaggaggacctgttgaccttactttgaagcagccaagatgttttgtattaatggatcacattttgaatttgaagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttagaggctgtgatagctatatggtttatttgtttgataaaagtaaaactgtatatgaagggccatttgcttccagaagtttatctgattgtgtaaattatattgtacaggacagcaaaatacagcttccaattatacagctgcgtaaagtgtgggctgaagcagtgcactatgtgtctggactaaaagaagactatagcaggctctttcagggacaaagggcagcaatgttaagtcttcttagatataatgctaacttaacaaaaatgaagaacactttgatctcagcatcacaacaactgaaagctaaattggagttttttcacaaaagcattcagcttgacttggagagatacagcgagcagatgacgtatgggatatcttcagaaaaaatgctaaaagcatggaaagaaatggaagaaaaggccatccactatgctgaggttggtgtcattggatacctggaggatcagattatgtctttgcatgctgaaatcatggggctacagaagagcccctatggaagacgtcagggagacttgatggaatctctggaacagcgtgccattgatctatataagcagttaaaacacagaccttcagatcactcctacagtgacagcacagagatggtgaaaatcattgtgcacactgtgcagagtcaggaccgtgtgctcaaggagctgtttggtcatttgagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtacacagagttctgcccgctctcttgtaggatccagtctagaaggtgcagtaacccctcagacatcagcatggctgcccccgacttcagcagaacatgatcattctctgtcatgtgtggtaactcctcaagatggggagacttcagcacaaatgatagaagaaaatttgaactgccttggccatttaagcactattattcatgaggcaaatgaggaacagggcaatagtatgatgaatcttgattggagttggttaacagaatga

SEQ ID NO: 8765 - DNA, 3201 bp, Artificial Sequence
  Synthetic Polynucleotide encoding a CAR with optional accessory module(s)
atggccttaccagtgaccgccttgctcctgccgctggccttgctgctccacgccgccaggccgcagtctgctctgacccagcctagaagcgtgtcagcctctcctggacagagcgtgaccatcagctgtaccggcacacacaacctggtgtcctggtgtcagcatcagcctggcagagcccctaagctgctgatctacgacttcaacaagcggcctagcggcgtgcccgatagattttctggatctggctctggcggcaccgccagcctgacaattactggcctccaggacgacgacgatgccgagtatttctgctgggcctacgaagcctttggcggaggcacaaagctgacagtgcttggactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagctgatcttgttcagtctggcgctgtggtcaagaaacccggcgatagcgtgcggatctcttgcgaggctcagggctacagattccccgactacatcatccactggattcggagagccccaggccagggacctgaatggatgggctggatgaatcctatgggcggccaagtgaacatcccctggaagtttcagggcagagtgtccatgaccagagacacctctatcgagactgccttcctggacctgaggggcctgaagtctgatgacaccgccgtgtactactgcgtgcgggacagaagcaatggcagcggcaagagattcgagagcagcaactggttcctggatctgtggggaagaggcaccgctgtgacaatccagtctgctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 8766 - DNA, 2013 bp, Artificial Sequence
  Synthetic Polynucleotide encoding a CAR with optional accessory module(s)
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccgcagtctgctctgacccagcctagaagcgtgtcagcctctcctggacagagcgtgaccatcagctgtaccggcacacacaacctggtgtcctggtgtcagcatcagcctggcagagcccctaagctgctgatctacgacttcaacaagcggcctagcggcgtgcccgatagattttctggatctggctctggcggcaccgccagcctgacaattactggcctccaggacgacgacgatgccgagtatttctgctgggcctacgaagcctttggcggaggcacaaagctgacagtgcttggaggcggaggcggaagtggaggcggaggatctggcggcggaggctctgctgatcttgttcagtctggcgctgtggtcaagaaacccggcgatagcgtgcggatctcttgcgaggctcagggctacagattccccgactacatcatccactggattcggagagccccaggccagggacctgaatggatgggctggatgaatcctatgggcggccaagtgaacatcccctggaagtttcagggcagagtgtccatgaccagagacacctctatcgagactgccttcctggacctgaggggcctgaagtctgatgacaccgccgtgtactactgcgtgcgggacagaagcaatggcagcggcaagagattcgagagcagcaactggttcctggatctgtggggaagaggcaccgctgtgacaatccagtctgctacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 8767 - DNA, 1953 bp, Artificial Sequence
  Synthetic Polynucleotide encoding a CAR with optional accessory module(s)
atggccttaccagtgaccgccttgctcctgccgctggccttgctgctccacgccgccaggccgcagtctgctctgacccagcctagaagcgtgtcagcctctcctggacagagcgtgaccatcagctgtaccggcacacacaacctggtgtcctggtgtcagcatcagcctggcagagcccctaagctgctgatctacgacttcaacaagcggcctagcggcgtgcccgatagattttctggatctggctctggcggcaccgccagcctgacaattactggcctccaggacgacgacgatgccgagtatttctgctgggcctacgaagcctttggcggaggcacaaagctgacagtgcttggactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagctgatcttgttcagtctggcgctgtggtcaagaaacccggcgatagcgtgcggatctcttgcgaggctcagggctacagattccccgactacatcatccactggattcggagagccccaggccagggacctgaatggatgggctggatgaatcctatgggcggccaagtgaacatcccctggaagtttcagggcagagtgtccatgaccagagacacctctatcgagactgccttcctggacctgaggggcctgaagtctgatgacaccgccgtgtactactgcgtgcgggacagaagcaatggcagcggcaagagattcgagagcagcaactggttcctggatctgtggggaagaggcaccgctgtgacaatccagtctgctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 8768 - DNA, 1863 bp, Artificial Sequence
  Synthetic Polynucleotide encoding a CAR with optional accessory module(s)
atggccttaccagtgaccgccttgctcctgccgctggccttgctgctccacgccgccaggccgcagtctgctctgacccagcctagaagcgtgtcagcctctcctggacagagcgtgaccatcagctgtaccggcacacacaacctggtgtcctggtgtcagcatcagcctggcagagcccctaagctgctgatctacgacttcaacaagcggcctagcggcgtgcccgatagattttctggatctggctctggcggcaccgccagcctgacaattactggcctccaggacgacgacgatgccgagtatttctgctgggcctacgaagcctttggcggaggcacaaagctgacagtgcttggactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagctgatcttgttcagtctggcgctgtggtcaagaaacccggcgatagcgtgcggatctcttgcgaggctcagggctacagattccccgactacatcatccactggattcggagagccccaggccagggacctgaatggatgggctggatgaatcctatgggcggccaagtgaacatcccctggaagtttcagggcagagtgtccatgaccagagacacctctatcgagactgccttcctggacctgaggggcctgaagtctgatgacaccgccgtgtactactgcgtgcgggacagaagcaatggcagcggcaagagattcgagagcagcaactggttcctggatctgtggggaagaggcaccgctgtgacaatccagtctgctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 8769 - DNA, 2109 bp, Artificial Sequence
  Synthetic Polynucleotide encoding a CAR with optional accessory module(s)
atggccttaccagtgaccgccttgctcctgccgctggccttgctgctccacgccgccaggccgcagtctgctctgacccagcctagaagcgtgtcagcctctcctggacagagcgtgaccatcagctgtaccggcacacacaacctggtgtcctggtgtcagcatcagcctggcagagcccctaagctgctgatctacgacttcaacaagcggcctagcggcgtgcccgatagattttctggatctggctctggcggcaccgccagcctgacaattactggcctccaggacgacgacgatgccgagtatttctgctgggcctacgaagcctttggcggaggcacaaagctgacagtgcttggactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagctgatcttgttcagtctggcgctgtggtcaagaaacccggcgatagcgtgcggatctcttgcgaggctcagggctacagattccccgactacatcatccactggattcggagagccccaggccagggacctgaatggatgggctggatgaatcctatgggcggccaagtgaacatcccctggaagtttcagggcagagtgtccatgaccagagacacctctatcgagactgccttcctggacctgaggggcctgaagtctgatgacaccgccgtgtactactgcgtgcgggacagaagcaatggcagcggcaagagattcgagagcagcaactggttcctggatctgtggggaagaggcaccgctgtgacaatccagtctgctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 8770 - DNA, 2157 bp, Artificial Sequence
  Synthetic Polynucleotide encoding a CAR with optional accessory module(s)
atggccttaccagtgaccgccttgctcctgccgctggccttgctgctccacgccgccaggccgctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccgcagtctgctctgacccagcctagaagcgtgtcagcctctcctggacagagcgtgaccatcagctgtaccggcacacacaacctggtgtcctggtgtcagcatcagcctggcagagcccctaagctgctgatctacgacttcaacaagcggcctagcggcgtgcccgatagattttctggatctggctctggcggcaccgccagcctgacaattactggcctccaggacgacgacgatgccgagtatttctgctgggcctacgaagcctttggcggaggcacaaagctgacagtgcttggaggcggaggcggaagtggaggcggaggatctggcggcggaggctctgctgatcttgttcagtctggcgctgtggtcaagaaacccggcgatagcgtgcggatctcttgcgaggctcagggctacagattccccgactacatcatccactggattcggagagccccaggccagggacctgaatggatgggctggatgaatcctatgggcggccaagtgaacatcccctggaagtttcagggcagagtgtccatgaccagagacacctctatcgagactgccttcctggacctgaggggcctgaagtctgatgacaccgccgtgtactactgcgtgcgggacagaagcaatggcagcggcaagagattcgagagcagcaactggttcctggatctgtggggaagaggcaccgctgtgacaatccagtctgctacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 8771 - DNA, 1974 bp, Artificial Sequence
  Synthetic Polynucleotide encoding a CAR with optional accessory module(s)
atggccttaccagtgaccgccttgctcctgccgctggccttgctgctccacgccgccaggccgcagtctgctctgacccagcctagaagcgtgtcagcctctcctggacagagcgtgaccatcagctgtaccggcacacacaacctggtgtcctggtgtcagcatcagcctggcagagcccctaagctgctgatctacgacttcaacaagcggcctagcggcgtgcccgatagattttctggatctggctctggcggcaccgccagcctgacaattactggcctccaggacgacgacgatgccgagtatttctgctgggcctacgaagcctttggcggaggcacaaagctgacagtgcttggactcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagctgatcttgttcagtctggcgctgtggtcaagaaacccggcgatagcgtgcggatctcttgcgaggctcagggctacagattccccgactacatcatccactggattcggagagccccaggccagggacctgaatggatgggctggatgaatcctatgggcggccaagtgaacatcccctggaagtttcagggcagagtgtccatgaccagagacacctctatcgagactgccttcctggacctgaggggcctgaagtctgatgacaccgccgtgtactactgcgtgcgggacagaagcaatggcagcggcaagagattcgagagcagcaactggttcctggatctgtggggaagaggcaccgctgtgacaatccagtctgctacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctc

SEQ ID NO: 8772 - DNA, 1491 bp, Artificial Sequence
  Synthetic Polynucleotide encoding a CAR with optional accessory module(s)
atggccttaccagtgaccgccttgctcctgccgctggccttgctgctccacgccgccaggccggcatctgccctgactcagcctgcctccatgtctgcgtcccctggacagtcggtaaccatctcgtgctctggaaccagacacataatctctgcttggttccaacaatatccaggcaaaccacccaaactcataatttttgacgacgataagcgtccctctggagttcctagtcgcttctctgcctccaggcctggcgacacggcctccctgacaatctctaatgttcaacctgaggacgaggcgacgtacatttgcaatacatatgaattctttggcggagggaccagattgaccgtcctaagtggcggaggcggaagtggaggcggaggatctggcggcggaggctctcacgtccaattggtgcagtctggaggtggggtgaagaagattggggccgctgtgaggatctcctgcgaggtgactggatataaattcatggaccaactcataaactgggtgcggcaggcccccggtcagggccttgagtggatgggatggatgaatccaacatatggacaagtaaattattcatggagatttgaaggaagggtcaccatgaccagggacatggacaccgagacggccttcatggagttgagaggactgagagtggacgacacggccgtctattattgcgcgaggggaccctctggggaaaattatccttttcactattggggccagggtgtccgagtggtcgtctcgtcacccacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 8773 - DNA, 1494 bp, Artificial Sequence
  Synthetic Polynucleotide encoding a CAR with optional accessory module(s)
atggccttaccagtgaccgccttgctcctgccgctggccttgctgctccacgccgccaggccgcacgtccaattggtgcagtctggaggtggggtgaagaagattggggccgctgtgaggatctcctgcgaggtgactggatataaattcatggaccaactcataaactgggtgcggcaggcccccggtcagggccttgagtggatgggatggatgaatccaacatatggacaagtaaattattcatggagatttgaaggaagggtcaccatgaccagggacatggacaccgagacggccttcatggagttgagaggactgagagtggacgacacggccgtctattattgcgcgaggggaccctctggggaaaattatccttttcactattggggccagggtgtccgagtggtcgtctcgtcacccggcggaggcggaagtggaggcggaggatctggcggcggaggctcttgagcatctgccctgactcagcctgcctccatgtctgcgtcccctggacagtcggtaaccatctcgtgctctggaaccagacacataatctctgcttggttccaacaatatccaggcaaaccacccaaactcataatttttgacgacgataagcgtccctctggagttcctagtcgcttctctgcctccaggcctggcgacacggcctccctgacaatctctaatgttcaacctgaggacgaggcgacgtacatttgcaatacatatgaattctttggcggagggaccagattgaccgtcctaagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 8774 - DNA, 2019 bp, Artificial Sequence
  Synthetic Polynucleotide encoding a CAR with optional accessory module(s)
atggccttaccagtgaccgccttgctcctgccgctggccttgctgctccacgccgccaggccggcatctgccctgactcagcctgcctccatgtctgcgtcccctggacagtcggtaaccatctcgtgctctggaaccagacacataatctctgcttggttccaacaatatccaggcaaaccacccaaactcataatttttgacgacgataagcgtccctctggagttcctagtcgcttctctgcctccaggcctggcgacacggcctccctgacaatctctaatgttcaacctgaggacgaggcgacgtacatttgcaatacatatgaattctttggcggagggaccagattgaccgtcctaagtggcggaggcggaagtggaggcggaggatctggcggcggaggctctcacgtccaattggtgcagtctggaggtggggtgaagaagattggggccgctgtgaggatctcctgcgaggtgactggatataaattcatggaccaactcataaactgggtgcggcaggcccccggtcagggccttgagtggatgggatggatgaatccaacatatggacaagtaaattattcatggagatttgaaggaagggtcaccatgaccagggacatggacaccgagacggccttcatggagttgagaggactgagagtggacgacacggccgtctattattgcgcgaggggaccctctggggaaaattatccttttcactattggggccagggtgtccgagtggtcgtctcgtcacccacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccatga

SEQ ID NO: 8775 - DNA, 2712 bp, Artificial Sequence
  Synthetic Polynucleotide encoding a CAR with optional accessory module(s)
atggccttaccagtgaccgccttgctcctgccgctggccttgctgctccacgccgccaggccggcatctgccctgactcagcctgcctccatgtctgcgtcccctggacagtcggtaaccatctcgtgctctggaaccagacacataatctctgcttggttccaacaatatccaggcaaaccacccaaactcataatttttgacgacgataagcgtccctctggagttcctagtcgcttctctgcctccaggcctggcgacacggcctccctgacaatctctaatgttcaacctgaggacgaggcgacgtacatttgcaatacatatgaattctttggcggagggaccagattgaccgtcctaagtggcggaggcggaagtggaggcggaggatctggcggcggaggctctcacgtccaattggtgcagtctggaggtggggtgaagaagattggggccgctgtgaggatctcctgcgaggtgactggatataaattcatggaccaactcataaactgggtgcggcaggcccccggtcagggccttgagtggatgggatggatgaatccaacatatggacaagtaaattattcatggagatttgaaggaagggtcaccatgaccagggacatggacaccgagacggccttcatggagttgagaggactgagagtggacgacacggccgtctattattgcgcgaggggaccctctggggaaaattatccttttcactattggggccagggtgtccgagtggtcgtctcgtcacccacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8776 - DNA, 2676 bp, Artificial Sequence
  Synthetic Polynucleotide encoding a CAR with optional accessory module(s)
atggccttaccagtgaccgccttgctcctgccgctggccttgctgctccacgccgccaggccggcatctgccctgactcagcctgcctccatgtctgcgtcccctggacagtcggtaaccatctcgtgctctggaaccagacacataatctctgcttggttccaacaatatccaggcaaaccacccaaactcataatttttgacgacgataagcgtccctctggagttcctagtcgcttctctgcctccaggcctggcgacacggcctccctgacaatctctaatgttcaacctgaggacgaggcgacgtacatttgcaatacatatgaattctttggcggagggaccagattgaccgtcctaagtggcggaggcggaagtggaggcggaggatctggcggcggaggctctcacgtccaattggtgcagtctggaggtggggtgaagaagattggggccgctgtgaggatctcctgcgaggtgactggatataaattcatggaccaactcataaactgggtgcggcaggcccccggtcagggccttgagtggatgggatggatgaatccaacatatggacaagtaaattattcatggagatttgaaggaagggtcaccatgaccagggacatggacaccgagacggccttcatggagttgagaggactgagagtggacgacacggccgtctattattgcgcgaggggaccctctggggaaaattatccttttcactattggggccagggtgtccgagtggtcgtctcgtcacccacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8777 - DNA, 2571 bp, Artificial Sequence
  Synthetic Polynucleotide encoding a CAR with optional accessory module(s)
atggccttaccagtgaccgccttgctcctgccgctggccttgctgctccacgccgccaggccggcatctgccctgactcagcctgcctccatgtctgcgtcccctggacagtcggtaaccatctcgtgctctggaaccagacacataatctctgcttggttccaacaatatccaggcaaaccacccaaactcataatttttgacgacgataagcgtccctctggagttcctagtcgcttctctgcctccaggcctggcgacacggcctccctgacaatctctaatgttcaacctgaggacgaggcgacgtacatttgcaatacatatgaattctttggcggagggaccagattgaccgtcctaagtggcggaggcggaagtggaggcggaggatctggcggcggaggctctcacgtccaattggtgcagtctggaggtggggtgaagaagattggggccgctgtgaggatctcctgcgaggtgactggatataaattcatggaccaactcataaactgggtgcggcaggcccccggtcagggccttgagtggatgggatggatgaatccaacatatggacaagtaaattattcatggagatttgaaggaagggtcaccatgaccagggacatggacaccgagacggccttcatggagttgagaggactgagagtggacgacacggccgtctattattgcgcgaggggaccctctggggaaaattatccttttcactattggggccagggtgtccgagtggtcgtctcgtcacccacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8778 - DNA, 2601 bp, Artificial Sequence
  Synthetic Polynucleotide encoding a CAR with optional accessory module(s)
atggccttaccagtgaccgccttgctcctgccgctggccttgctgctccacgccgccaggccggcatctgccctgactcagcctgcctccatgtctgcgtcccctggacagtcggtaaccatctcgtgctctggaaccagacacataatctctgcttggttccaacaatatccaggcaaaccacccaaactcataatttttgacgacgataagcgtccctctggagttcctagtcgcttctctgcctccaggcctggcgacacggcctccctgacaatctctaatgttcaacctgaggacgaggcgacgtacatttgcaatacatatgaattctttggcggagggaccagattgaccgtcctaagtggcggaggcggaagtggaggcggaggatctggcggcggaggctctcacgtccaattggtgcagtctggaggtggggtgaagaagattggggccgctgtgaggatctcctgcgaggtgactggatataaattcatggaccaactcataaactgggtgcggcaggcccccggtcagggccttgagtggatgggatggatgaatccaacatatggacaagtaaattattcatggagatttgaaggaagggtcaccatgaccagggacatggacaccgagacggccttcatggagttgagaggactgagagtggacgacacggccgtctattattgcgcgaggggaccctctggggaaaattatccttttcactattggggccagggtgtccgagtggtcgtctcgtcacccacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8779 - DNA, 2550 bp, Artificial Sequence
  Synthetic Polynucleotide encoding a CAR with optional accessory module(s)
atggccttaccagtgaccgccttgctcctgccgctggccttgctgctccacgccgccaggccggcatctgccctgactcagcctgcctccatgtctgcgtcccctggacagtcggtaaccatctcgtgctctggaaccagacacataatctctgcttggttccaacaatatccaggcaaaccacccaaactcataatttttgacgacgataagcgtccctctggagttcctagtcgcttctctgcctccaggcctggcgacacggcctccctgacaatctctaatgttcaacctgaggacgaggcgacgtacatttgcaatacatatgaattctttggcggagggaccagattgaccgtcctaagtggcggaggcggaagtggaggcggaggatctggcggcggaggctctcacgtccaattggtgcagtctggaggtggggtgaagaagattggggccgctgtgaggatctcctgcgaggtgactggatataaattcatggaccaactcataaactgggtgcggcaggcccccggtcagggccttgagtggatgggatggatgaatccaacatatggacaagtaaattattcatggagatttgaaggaagggtcaccatgaccagggacatggacaccgagacggccttcatggagttgagaggactgagagtggacgacacggccgtctattattgcgcgaggggaccctctggggaaaattatccttttcactattggggccagggtgtccgagtggtcgtctcgtcacccacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8780 - DNA, 2526 bp, Artificial Sequence
  Synthetic Polynucleotide encoding a CAR with optional accessory module(s)
atggccttaccagtgaccgccttgctcctgccgctggccttgctgctccacgccgccaggccgcacgtccaattggtgcagtctggaggtggggtgaagaagattggggccgctgtgaggatctcctgcgaggtgactggatataaattcatggaccaactcataaactgggtgcggcaggcccccggtcagggccttgagtggatgggatggatgaatccaacatatggacaagtaaattattcatggagatttgaaggaagggtcaccatgaccagggacatggacaccgagacggccttcatggagttgagaggactgagagtggacgacacggccgtctattattgcgcgaggggaccctctggggaaaattatccttttcactattggggccagggtgtccgagtggtcgtctcgtcacccggcggaggcggaagtggaggcggaggatctggcggcggaggctcttgagcatctgccctgactcagcctgcctccatgtctgcgtcccctggacagtcggtaaccatctcgtgctctggaaccagacacataatctctgcttggttccaacaatatccaggcaaaccacccaaactcataatttttgacgacgataagcgtccctctggagttcctagtcgcttctctgcctccaggcctggcgacacggcctccctgacaatctctaatgttcaacctgaggacgaggcgacgtacatttgcaatacatatgaattctttggcggagggaccagattgaccgtcctaagtacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccc

SEQ ID NO: 8781 - DNA, 2574 bp, Artificial Sequence
  Synthetic Polynucleotide encoding a CAR with optional accessory module(s)
atggccttaccagtgaccgccttgctcctgccgctggccttgctgctccacgccgccaggccgcacgtccaattggtgcagtctggaggtggggtgaagaagattggggccgctgtgaggatctcctgcgaggtgactggatataaattcatggaccaactcataaactgggtgcggcaggcccccggtcagggccttgagtggatgggatggatgaatccaacatatggacaagtaaattattcatggagatttgaaggaagggtcaccatgaccagggacatggacaccgagacggccttcatggagttgagaggactgagagtggacgacacggccgtctattattgcgcgaggggaccctctggggaaaattatccttttcactattggggccagggtgtccgagtggtcgtctcgtcacccggcggaggcggaagtggaggcggaggatctggcggcggaggctcttgagcatctgccctgactcagcctgcctccatgtctgcgtcccctggacagtcggtaaccatctcgtgctctggaaccagacacataatctctgcttggttccaacaatatccaggcaaaccacccaaactcataatttttgacgacgataagcgtccctctggagttcctagtcgcttctctgcctccaggcctggcgacacggcctccctgacaatctctaatgttcaacctgaggacgaggcgacgtacatttgcaatacatatgaattctttggcggagggaccagattgaccgtcctaagtacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8782 - DNA, 2604 bp, Artificial Sequence
  Synthetic Polynucleotide encoding a CAR with optional accessory module(s)
atggccttaccagtgaccgccttgctcctgccgctggccttgctgctccacgccgccaggccgcacgtccaattggtgcagtctggaggtggggtgaagaagattggggccgctgtgaggatctcctgcgaggtgactggatataaattcatggaccaactcataaactgggtgcggcaggcccccggtcagggccttgagtggatgggatggatgaatccaacatatggacaagtaaattattcatggagatttgaaggaagggtcaccatgaccagggacatggacaccgagacggccttcatggagttgagaggactgagagtggacgacacggccgtctattattgcgcgaggggaccctctggggaaaattatccttttcactattggggccagggtgtccgagtggtcgtctcgtcacccggcggaggcggaagtggaggcggaggatctggcggcggaggctcttgagcatctgccctgactcagcctgcctccatgtctgcgtcccctggacagtcggtaaccatctcgtgctctggaaccagacacataatctctgcttggttccaacaatatccaggcaaaccacccaaactcataatttttgacgacgataagcgtccctctggagttcctagtcgcttctctgcctccaggcctggcgacacggcctccctgacaatctctaatgttcaacctgaggacgaggcgacgtacatttgcaatacatatgaattctttggcggagggaccagattgaccgtcctaagtacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8783 - DNA, 2553 bp, Artificial Sequence
  Synthetic Polynucleotide encoding a CAR with optional accessory module(s)
atggccttaccagtgaccgccttgctcctgccgctggccttgctgctccacgccgccaggccgcacgtccaattggtgcagtctggaggtggggtgaagaagattggggccgctgtgaggatctcctgcgaggtgactggatataaattcatggaccaactcataaactgggtgcggcaggcccccggtcagggccttgagtggatgggatggatgaatccaacatatggacaagtaaattattcatggagatttgaaggaagggtcaccatgaccagggacatggacaccgagacggccttcatggagttgagaggactgagagtggacgacacggccgtctattattgcgcgaggggaccctctggggaaaattatccttttcactattggggccagggtgtccgagtggtcgtctcgtcacccggcggaggcggaagtggaggcggaggatctggcggcggaggctcttgagcatctgccctgactcagcctgcctccatgtctgcgtcccctggacagtcggtaaccatctcgtgctctggaaccagacacataatctctgcttggttccaacaatatccaggcaaaccacccaaactcataatttttgacgacgataagcgtccctctggagttcctagtcgcttctctgcctccaggcctggcgacacggcctccctgacaatctctaatgttcaacctgaggacgaggcgacgtacatttgcaatacatatgaattctttggcggagggaccagattgaccgtcctaagtacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8784 - DNA, 1845 bp, Artificial Sequence
  Synthetic Polynucleotide encoding a CAR with optional accessory module(s)
atggccttaccagtgaccgccttgctcctgccgctggccttgctgctccacgccgccaggccggcatctgccctgactcagcctgcctccatgtctgcgtcccctggacagtcggtaaccatctcgtgctctggaaccagacacataatctctgcttggttccaacaatatccaggcaaaccacccaaactcataatttttgacgacgataagcgtccctctggagttcctagtcgcttctctgcctccaggcctggcgacacggcctccctgacaatctctaatgttcaacctgaggacgaggcgacgtacatttgcaatacatatgaattctttggcggagggaccagattgaccgtcctaagtctcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacacgtccaattggtgcagtctggaggtggggtgaagaagattggggccgctgtgaggatctcctgcgaggtgactggatataaattcatggaccaactcataaactgggtgcggcaggcccccggtcagggccttgagtggatgggatggatgaatccaacatatggacaagtaaattattcatggagatttgaaggaagggtcaccatgaccagggacatggacaccgagacggccttcatggagttgagaggactgagagtggacgacacggccgtctattattgcgcgaggggaccctctggggaaaattatccttttcactattggggccagggtgtccgagtggtcgtctcgtcacccacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 8785 - DNA, 1860 bp, Artificial Sequence
  Synthetic Polynucleotide encoding a CAR with optional accessory module(s)
atggccttaccagtgaccgccttgctcctgccgctggccttgctgctccacgccgccaggccggcatctgccctgactcagcctgcctccatgtctgcgtcccctggacagtcggtaaccatctcgtgctctggaaccagacacataatctctgcttggttccaacaatatccaggcaaaccacccaaactcataatttttgacgacgataagcgtccctctggagttcctagtcgcttctctgcctccaggcctggcgacacggcctccctgacaatctctaatgttcaacctgaggacgaggcgacgtacatttgcaatacatatgaattctttggcggagggaccagattgaccgtcctaagtctcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacacgtccaattggtgcagtctggaggtggggtgaagaagattggggccgctgtgaggatctcctgcgaggtgactggatataaattcatggaccaactcataaactgggtgcggcaggcccccggtcagggccttgagtggatgggatggatgaatccaacatatggacaagtaaattattcatggagatttgaaggaagggtcaccatgaccagggacatggacaccgagacggccttcatggagttgagaggactgagagtggacgacacggccgtctattattgcgcgaggggaccctctggggaaaattatccttttcactattggggccagggtgtccgagtggtcgtctcgtcacccacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 8786 - DNA, 1890 bp, Artificial Sequence
  Synthetic Polynucleotide encoding a CAR with optional accessory module(s)
atggccttaccagtgaccgccttgctcctgccgctggccttgctgctccacgccgccaggccggcatctgccctgactcagcctgcctccatgtctgcgtcccctggacagtcggtaaccatctcgtgctctggaaccagacacataatctctgcttggttccaacaatatccaggcaaaccacccaaactcataatttttgacgacgataagcgtccctctggagttcctagtcgcttctctgcctccaggcctggcgacacggcctccctgacaatctctaatgttcaacctgaggacgaggcgacgtacatttgcaatacatatgaattctttggcggagggaccagattgaccgtcctaagtctcgagcctggtggcggaggatctcctgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacacgtccaattggtgcagtctggaggtggggtgaagaagattggggccgctgtgaggatctcctgcgaggtgactggatataaattcatggaccaactcataaactgggtgcggcaggcccccggtcagggccttgagtggatgggatggatgaatccaacatatggacaagtaaattattcatggagatttgaaggaagggtcaccatgaccagggacatggacaccgagacggccttcatggagttgagaggactgagagtggacgacacggccgtctattattgcgcgaggggaccctctggggaaaattatccttttcactattggggccagggtgtccgagtggtcgtctcgtcacccacgcgtcctggcggaggcgggtctcctatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 8787 - DNA, 1887 bp, Artificial Sequence
  Synthetic Polynucleotide encoding a CAR with optional accessory module(s)
atggccttaccagtgaccgccttgctcctgccgctggccttgctgctccacgccgccaggccggcatctgccctgactcagcctgcctccatgtctgcgtcccctggacagtcggtaaccatctcgtgctctggaaccagacacataatctctgcttggttccaacaatatccaggcaaaccacccaaactcataatttttgacgacgataagcgtccctctggagttcctagtcgcttctctgcctccaggcctggcgacacggcctccctgacaatctctaatgttcaacctgaggacgaggcgacgtacatttgcaatacatatgaattctttggcggagggaccagattgaccgtcctaagtctcgaggttgcggcgctcgaaagggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacacgtccaattggtgcagtctggaggtggggtgaagaagattggggccgctgtgaggatctcctgcgaggtgactggatataaattcatggaccaactcataaactgggtgcggcaggcccccggtcagggccttgagtggatgggatggatgaatccaacatatggacaagtaaattattcatggagatttgaaggaagggtcaccatgaccagggacatggacaccgagacggccttcatggagttgagaggactgagagtggacgacacggccgtctattattgcgcgaggggaccctctggggaaaattatccttttcactattggggccagggtgtccgagtggtcgtctcgtcacccacgcgtcgtgtggctgcgctcaaggagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 8788 - DNA, 1875 bp, Artificial Sequence
  Synthetic Polynucleotide encoding a CAR with optional accessory module(s)
atggccttaccagtgaccgccttgctcctgccgctggccttgctgctccacgccgccaggccggcatctgccctgactcagcctgcctccatgtctgcgtcccctggacagtcggtaaccatctcgtgctctggaaccagacacataatctctgcttggttccaacaatatccaggcaaaccacccaaactcataatttttgacgacgataagcgtccctctggagttcctagtcgcttctctgcctccaggcctggcgacacggcctccctgacaatctctaatgttcaacctgaggacgaggcgacgtacatttgcaatacatatgaattctttggcggagggaccagattgaccgtcctaagtctcgaggccgcagcaaaggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacacgtccaattggtgcagtctggaggtggggtgaagaagattggggccgctgtgaggatctcctgcgaggtgactggatataaattcatggaccaactcataaactgggtgcggcaggcccccggtcagggccttgagtggatgggatggatgaatccaacatatggacaagtaaattattcatggagatttgaaggaagggtcaccatgaccagggacatggacaccgagacggccttcatggagttgagaggactgagagtggacgacacggccgtctattattgcgcgaggggaccctctggggaaaattatccttttcactattggggccagggtgtccgagtggtcgtctcgtcacccacgcgtgaagcagccgccaagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 8789 - DNA, 1938 bp, Artificial Sequence
  Synthetic Polynucleotide encoding a CAR with optional accessory module(s)
atggccttaccagtgaccgccttgctcctgccgctggccttgctgctccacgccgccaggccggcatctgccctgactcagcctgcctccatgtctgcgtcccctggacagtcggtaaccatctcgtgctctggaaccagacacataatctctgcttggttccaacaatatccaggcaaaccacccaaactcataatttttgacgacgataagcgtccctctggagttcctagtcgcttctctgcctccaggcctggcgacacggcctccctgacaatctctaatgttcaacctgaggacgaggcgacgtacatttgcaatacatatgaattctttggcggagggaccagattgaccgtcctaagtctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacacgtccaattggtgcagtctggaggtggggtgaagaagattggggccgctgtgaggatctcctgcgaggtgactggatataaattcatggaccaactcataaactgggtgcggcaggcccccggtcagggccttgagtggatgggatggatgaatccaacatatggacaagtaaattattcatggagatttgaaggaagggtcaccatgaccagggacatggacaccgagacggccttcatggagttgagaggactgagagtggacgacacggccgtctattattgcgcgaggggaccctctggggaaaattatccttttcactattggggccagggtgtccgagtggtcgtctcgtcacccacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 8790 - DNA, 3207 bp, Artificial Sequence
  Synthetic Polynucleotide encoding a CAR with optional accessory module(s)
atggccttaccagtgaccgccttgctcctgccgctggccttgctgctccacgccgccaggccggcatctgccctgactcagcctgcctccatgtctgcgtcccctggacagtcggtaaccatctcgtgctctggaaccagacacataatctctgcttggttccaacaatatccaggcaaaccacccaaactcataatttttgacgacgataagcgtccctctggagttcctagtcgcttctctgcctccaggcctggcgacacggcctccctgacaatctctaatgttcaacctgaggacgaggcgacgtacatttgcaatacatatgaattctttggcggagggaccagattgaccgtcctaagtctcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacacgtccaattggtgcagtctggaggtggggtgaagaagattggggccgctgtgaggatctcctgcgaggtgactggatataaattcatggaccaactcataaactgggtgcggcaggcccccggtcagggccttgagtggatgggatggatgaatccaacatatggacaagtaaattattcatggagatttgaaggaagggtcaccatgaccagggacatggacaccgagacggccttcatggagttgagaggactgagagtggacgacacggccgtctattattgcgcgaggggaccctctggggaaaattatccttttcactattggggccagggtgtccgagtggtcgtctcgtcacccacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8791 - DNA, 3210 bp, Artificial Sequence
  Synthetic Polynucleotide encoding a CAR with optional accessory module(s)
atggccttaccagtgaccgccttgctcctgccgctggccttgctgctccacgccgccaggccggcatctgccctgactcagcctgcctccatgtctgcgtcccctggacagtcggtaaccatctcgtgctctggaaccagacacataatctctgcttggttccaacaatatccaggcaaaccacccaaactcataatttttgacgacgataagcgtccctctggagttcctagtcgcttctctgcctccaggcctggcgacacggcctccctgacaatctctaatgttcaacctgaggacgaggcgacgtacatttgcaatacatatgaattctttggcggagggaccagattgaccgtcctaagtctcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacacgtccaattggtgcagtctggaggtggggtgaagaagattggggccgctgtgaggatctcctgcgaggtgactggatataaattcatggaccaactcataaactgggtgcggcaggcccccggtcagggccttgagtggatgggatggatgaatccaacatatggacaagtaaattattcatggagatttgaaggaagggtcaccatgaccagggacatggacaccgagacggccttcatggagttgagaggactgagagtggacgacacggccgtctattattgcgcgaggggaccctctggggaaaattatccttttcactattggggccagggtgtccgagtggtcgtctcgtcacccacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8792 - DNA, 3369 bp, Artificial Sequence
  Synthetic Polynucleotide encoding a CAR with optional accessory module(s)
atggccttaccagtgaccgccttgctcctgccgctggccttgctgctccacgccgccaggccggcatctgccctgactcagcctgcctccatgtctgcgtcccctggacagtcggtaaccatctcgtgctctggaaccagacacataatctctgcttggttccaacaatatccaggcaaaccacccaaactcataatttttgacgacgataagcgtccctctggagttcctagtcgcttctctgcctccaggcctggcgacacggcctccctgacaatctctaatgttcaacctgaggacgaggcgacgtacatttgcaatacatatgaattctttggcggagggaccagattgaccgtcctaagtctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacacgtccaattggtgcagtctggaggtggggtgaagaagattggggccgctgtgaggatctcctgcgaggtgactggatataaattcatggaccaactcataaactgggtgcggcaggcccccggtcagggccttgagtggatgggatggatgaatccaacatatggacaagtaaattattcatggagatttgaaggaagggtcaccatgaccagggacatggacaccgagacggccttcatggagttgagaggactgagagtggacgacacggccgtctattattgcgcgaggggaccctctggggaaaattatccttttcactattggggccagggtgtccgagtggtcgtctcgtcacccacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 8793 - DNA, 3219 bp, Artificial Sequence
  Synthetic Polynucleotide encoding a CAR with optional accessory module(s)
atggccttaccagtgaccgccttgctcctgccgctggccttgctgctccacgccgccaggccggcatctgccctgactcagcctgcctccatgtctgcgtcccctggacagtcggtaaccatctcgtgctctggaaccagacacataatctctgcttggttccaacaatatccaggcaaaccacccaaactcataatttttgacgacgataagcgtccctctggagttcctagtcgcttctctgcctccaggcctggcgacacggcctccctgacaatctctaatgttcaacctgaggacgaggcgacgtacatttgcaatacatatgaattctttggcggagggaccagattgaccgtcctaagtctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacacgtccaattggtgcagtctggaggtggggtgaagaagattggggccgctgtgaggatctcctgcgaggtgactggatataaattcatggaccaactcataaactgggtgcggcaggcccccggtcagggccttgagtggatgggatggatgaatccaacatatggacaagtaaattattcatggagatttgaaggaagggtcaccatgaccagggacatggacaccgagacggccttcatggagttgagaggactgagagtggacgacacggccgtctattattgcgcgaggggaccctctggggaaaattatccttttcactattggggccagggtgtccgagtggtcgtctcgtcacccacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8794 - DNA, 3207 bp, Artificial Sequence
  Synthetic Polynucleotide encoding a CAR with optional accessory module(s)
atggccttaccagtgaccgccttgctcctgccgctggccttgctgctccacgccgccaggccggcatctgccctgactcagcctgcctccatgtctgcgtcccctggacagtcggtaaccatctcgtgctctggaaccagacacataatctctgcttggttccaacaatatccaggcaaaccacccaaactcataatttttgacgacgataagcgtccctctggagttcctagtcgcttctctgcctccaggcctggcgacacggcctccctgacaatctctaatgttcaacctgaggacgaggcgacgtacatttgcaatacatatgaattctttggcggagggaccagattgaccgtcctaagtctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacacgtccaattggtgcagtctggaggtggggtgaagaagattggggccgctgtgaggatctcctgcgaggtgactggatataaattcatggaccaactcataaactgggtgcggcaggcccccggtcagggccttgagtggatgggatggatgaatccaacatatggacaagtaaattattcatggagatttgaaggaagggtcaccatgaccagggacatggacaccgagacggccttcatggagttgagaggactgagagtggacgacacggccgtctattattgcgcgaggggaccctctggggaaaattatccttttcactattggggccagggtgtccgagtggtcgtctcgtcacccacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggacgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8795 - DNA, 2658 bp, Artificial Sequence
  Synthetic Polynucleotide encoding a CAR with optional accessory module(s)
atggccttaccagtgaccgccttgctcctgccgctggccttgctgctccacgccgccaggccggcatctgccctgactcagcctgcctccatgtctgcgtcccctggacagtcggtaaccatctcgtgctctggaaccagacacataatctctgcttggttccaacaatatccaggcaaaccacccaaactcataatttttgacgacgataagcgtccctctggagttcctagtcgcttctctgcctccaggcctggcgacacggcctccctgacaatctctaatgttcaacctgaggacgaggcgacgtacatttgcaatacatatgaattctttggcggagggaccagattgaccgtcctaagtggcggaggcggaagtggaggcggaggatctggcggcggaggctctcacgtccaattggtgcagtctggaggtggggtgaagaagattggggccgctgtgaggatctcctgcgaggtgactggatataaattcatggaccaactcataaactgggtgcggcaggcccccggtcagggccttgagtggatgggatggatgaatccaacatatggacaagtaaattattcatggagatttgaaggaagggtcaccatgaccagggacatggacaccgagacggccttcatggagttgagaggactgagagtggacgacacggccgtctattattgcgcgaggggaccctctggggaaaattatccttttcactattggggccagggtgtccgagtggtcgtctcgtcacccacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 8796 - DNA, 3690 bp, Artificial Sequence
  Synthetic Polynucleotide encoding a CAR with optional accessory module(s)
atggccttaccagtgaccgccttgctcctgccgctggccttgctgctccacgccgccaggccggcatctgccctgactcagcctgcctccatgtctgcgtcccctggacagtcggtaaccatctcgtgctctggaaccagacacataatctctgcttggttccaacaatatccaggcaaaccacccaaactcataatttttgacgacgataagcgtccctctggagttcctagtcgcttctctgcctccaggcctggcgacacggcctccctgacaatctctaatgttcaacctgaggacgaggcgacgtacatttgcaatacatatgaattctttggcggagggaccagattgaccgtcctaagtggcggaggcggaagtggaggcggaggatctggcggcggaggctctcacgtccaattggtgcagtctggaggtggggtgaagaagattggggccgctgtgaggatctcctgcgaggtgactggatataaattcatggaccaactcataaactgggtgcggcaggcccccggtcagggccttgagtggatgggatggatgaatccaacatatggacaagtaaattattcatggagatttgaaggaagggtcaccatgaccagggacatggacaccgagacggccttcatggagttgagaggactgagagtggacgacacggccgtctattattgcgcgaggggaccctctggggaaaattatccttttcactattggggccagggtgtccgagtggtcgtctcgtcacccacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcgagctttgcacagaattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctca

SEQ ID NO: 8797 - DNA, 3210 bp, Artificial Sequence
  Synthetic Polynucleotide encoding a CAR with optional accessory module(s)
atggccttaccagtgaccgccttgctcctgccgctggccttgctgctccacgccgccaggccggcatctgccctgactcagcctgcctccatgtctgcgtcccctggacagtcggtaaccatctcgtgctctggaaccagacacataatctctgcttggttccaacaatatccaggcaaaccacccaaactcataatttttgacgacgataagcgtccctctggagttcctagtcgcttctctgcctccaggcctggcgacacggcctccctgacaatctctaatgttcaacctgaggacgaggcgacgtacatttgcaatacatatgaattctttggcggagggaccagattgaccgtcctaagtctcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacacgtccaattggtgcagtctggaggtggggtgaagaagattggggccgctgtgaggatctcctgcgaggtgactggatataaattcatggaccaactcataaactgggtgcggcaggcccccggtcagggccttgagtggatgggatggatgaatccaacatatggacaagtaaattattcatggagatttgaaggaagggtcaccatgaccagggacatggacaccgagacggccttcatggagttgagaggactgagagtggacgacacggccgtctattattgcgcgaggggaccctctggggaaaattatccttttcactattggggccagggtgtccgagtggtcgtctcgtcacccacgcgtgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8798 - DNA, 4185 bp, Artificial Sequence
  Synthetic Polynucleotide encoding a CAR with optional accessory module(s)
atggccttaccagtgaccgccttgctcctgccgctggccttgctgctccacgccgccaggccggcatctgccctgactcagcctgcctccatgtctgcgtcccctggacagtcggtaaccatctcgtgctctggaaccagacacataatctctgcttggttccaacaatatccaggcaaaccacccaaactcataatttttgacgacgataagcgtccctctggagttcctagtcgcttctctgcctccaggcctggcgacacggcctccctgacaatctctaatgttcaacctgaggacgaggcgacgtacatttgcaatacatatgaattctttggcggagggaccagattgaccgtcctaagtctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacacgtccaattggtgcagtctggaggtggggtgaagaagattggggccgctgtgaggatctcctgcgaggtgactggatataaattcatggaccaactcataaactgggtgcggcaggcccccggtcagggccttgagtggatgggatggatgaatccaacatatggacaagtaaattattcatggagatttgaaggaagggtcaccatgaccagggacatggacaccgagacggccttcatggagttgagaggactgagagtggacgacacggccgtctattattgcgcgaggggaccctctggggaaaattatccttttcactattggggccagggtgtccgagtggtcgtctcgtcacccacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggagcggcccccggggctgcggccgggcgcgggcgggccctgggagatgcgggagcggctgggcaccggcggcttcgggaacgtctgtctgtaccagcatcgggaacttgatctcaaaatagcaattaagtcttgtcgcctagagctaagtaccaaaaacagagaacgatggtgccatgaaatccagattatgaagaagttgaaccatgccaatgttgtaaaggcctgtgatgttcctgaagaattgaatattttgattcatgatgtgcctcttctagcaatggaatactgttctggaggagatctccgaaagctgctcaacaaaccagaaaattgttgtggacttaaagaaagccagatactttctttactaagtgatatagggtctgggattcgatatttgcatgaaaacaaaattatacatcgagatctaaaacctgaaaacatagttcttcaggatgttggtggaaagataatacataaaataattgatctgggatatgccaaagatgttgatcaaggagagctgtgtacagagtttgtgggaacactgcagtatctggccccagagctctttgagaataagccttacacagccactgttgattattggagctttgggaccatggtatttgaatgtattgctggatataggccttttttgcatcatctgcagccatttacctggcatgagaagattaagaagaaggatccaaagtgtatatttgcatgtgaagagatgtcaggagaagttcggtttagtagccatttacctcaaccaaatagcctttgtagtttaatagtagaacccatggaaaactggctacagttgatgttgaattgggaccctcagcagagaggaggacctgttgaccttactttgaagcagccaagatgttttgtattaatggatcacattttgaatttgaagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttagaggctgtgatagctatatggtttatttgtttgataaaagtaaaactgtatatgaagggccatttgcttccagaagtttatctgattgtgtaaattatattgtacaggacagcaaaatacagcttccaattatacagctgcgtaaagtgtgggctgaagcagtgcactatgtgtctggactaaaagaagactatagcaggctctttcagggacaaagggcagcaatgttaagtcttcttagatataatgctaacttaacaaaaatgaagaacactttgatctcagcatcacaacaactgaaagctaaattggagttttttcacaaaagcattcagcttgacttggagagatacagcgagcagatgacgtatgggatatcttcagaaaaaatgctaaaagcatggaaagaaatggaagaaaaggccatccactatgctgaggttggtgtcattggatacctggaggatcagattatgtctttgcatgctgaaatcatggggctacagaagagcccctatggaagacgtcagggagacttgatggaatctctggaacagcgtgccattgatctatataagcagttaaaacacagaccttcagatcactcctacagtgacagcacagagatggtgaaaatcattgtgcacactgtgcagagtcaggaccgtgtgctcaaggagctgtttggtcatttgagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtacacagagttctgcccgctctcttgtaggatccagtctagaaggtgcagtaacccctcagacatcagcatggctgcccccgacttcagcagaacatgatcattctctgtcatgtgtggtaactcctcaagatggggagacttcagcacaaatgatagaagaaaatttgaactgccttggccatttaagcactattattcatgaggcaaatgaggaacagggcaatagtatgatgaatcttgattggagttggttaacagaatga

SEQ ID NO: 8799 - DNA, 3183 bp, Artificial Sequence
  Synthetic Polynucleotide encoding a CAR with optional accessory module(s)
atggccttaccagtgaccgccttgctcctgccgctggccttgctgctccacgccgccaggccggcatctgccctgactcagcctgcctccatgtctgcgtcccctggacagtcggtaaccatctcgtgctctggaaccagacacataatctctgcttggttccaacaatatccaggcaaaccacccaaactcataatttttgacgacgataagcgtccctctggagttcctagtcgcttctctgcctccaggcctggcgacacggcctccctgacaatctctaatgttcaacctgaggacgaggcgacgtacatttgcaatacatatgaattctttggcggagggaccagattgaccgtcctaagtctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacacgtccaattggtgcagtctggaggtggggtgaagaagattggggccgctgtgaggatctcctgcgaggtgactggatataaattcatggaccaactcataaactgggtgcggcaggcccccggtcagggccttgagtggatgggatggatgaatccaacatatggacaagtaaattattcatggagatttgaaggaagggtcaccatgaccagggacatggacaccgagacggccttcatggagttgagaggactgagagtggacgacacggccgtctattattgcgcgaggggaccctctggggaaaattatccttttcactattggggccagggtgtccgagtggtcgtctcgtcacccacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 8800 - DNA, 1995 bp, Artificial Sequence
  Synthetic Polynucleotide encoding a CAR with optional accessory module(s)
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccggcatctgccctgactcagcctgcctccatgtctgcgtcccctggacagtcggtaaccatctcgtgctctggaaccagacacataatctctgcttggttccaacaatatccaggcaaaccacccaaactcataatttttgacgacgataagcgtccctctggagttcctagtcgcttctctgcctccaggcctggcgacacggcctccctgacaatctctaatgttcaacctgaggacgaggcgacgtacatttgcaatacatatgaattctttggcggagggaccagattgaccgtcctaagtggcggaggcggaagtggaggcggaggatctggcggcggaggctctcacgtccaattggtgcagtctggaggtggggtgaagaagattggggccgctgtgaggatctcctgcgaggtgactggatataaattcatggaccaactcataaactgggtgcggcaggcccccggtcagggccttgagtggatgggatggatgaatccaacatatggacaagtaaattattcatggagatttgaaggaagggtcaccatgaccagggacatggacaccgagacggccttcatggagttgagaggactgagagtggacgacacggccgtctattattgcgcgaggggaccctctggggaaaattatccttttcactattggggccagggtgtccgagtggtcgtctcgtcacccacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 8801 - DNA, 1935 bp, Artificial Sequence
  Synthetic Polynucleotide encoding a CAR with optional accessory module(s)
atggccttaccagtgaccgccttgctcctgccgctggccttgctgctccacgccgccaggccggcatctgccctgactcagcctgcctccatgtctgcgtcccctggacagtcggtaaccatctcgtgctctggaaccagacacataatctctgcttggttccaacaatatccaggcaaaccacccaaactcataatttttgacgacgataagcgtccctctggagttcctagtcgcttctctgcctccaggcctggcgacacggcctccctgacaatctctaatgttcaacctgaggacgaggcgacgtacatttgcaatacatatgaattctttggcggagggaccagattgaccgtcctaagtctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacacgtccaattggtgcagtctggaggtggggtgaagaagattggggccgctgtgaggatctcctgcgaggtgactggatataaattcatggaccaactcataaactgggtgcggcaggcccccggtcagggccttgagtggatgggatggatgaatccaacatatggacaagtaaattattcatggagatttgaaggaagggtcaccatgaccagggacatggacaccgagacggccttcatggagttgagaggactgagagtggacgacacggccgtctattattgcgcgaggggaccctctggggaaaattatccttttcactattggggccagggtgtccgagtggtcgtctcgtcacccacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 8802 - DNA, 1845 bp, Artificial Sequence
  Synthetic Polynucleotide encoding a CAR with optional accessory module(s)
atggccttaccagtgaccgccttgctcctgccgctggccttgctgctccacgccgccaggccggcatctgccctgactcagcctgcctccatgtctgcgtcccctggacagtcggtaaccatctcgtgctctggaaccagacacataatctctgcttggttccaacaatatccaggcaaaccacccaaactcataatttttgacgacgataagcgtccctctggagttcctagtcgcttctctgcctccaggcctggcgacacggcctccctgacaatctctaatgttcaacctgaggacgaggcgacgtacatttgcaatacatatgaattctttggcggagggaccagattgaccgtcctaagtctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacacgtccaattggtgcagtctggaggtggggtgaagaagattggggccgctgtgaggatctcctgcgaggtgactggatataaattcatggaccaactcataaactgggtgcggcaggcccccggtcagggccttgagtggatgggatggatgaatccaacatatggacaagtaaattattcatggagatttgaaggaagggtcaccatgaccagggacatggacaccgagacggccttcatggagttgagaggactgagagtggacgacacggccgtctattattgcgcgaggggaccctctggggaaaattatccttttcactattggggccagggtgtccgagtggtcgtctcgtcacccacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 8803 - DNA, 2091 bp, Artificial Sequence
  Synthetic Polynucleotide encoding a CAR with optional accessory module(s)
atggccttaccagtgaccgccttgctcctgccgctggccttgctgctccacgccgccaggccggcatctgccctgactcagcctgcctccatgtctgcgtcccctggacagtcggtaaccatctcgtgctctggaaccagacacataatctctgcttggttccaacaatatccaggcaaaccacccaaactcataatttttgacgacgataagcgtccctctggagttcctagtcgcttctctgcctccaggcctggcgacacggcctccctgacaatctctaatgttcaacctgaggacgaggcgacgtacatttgcaatacatatgaattctttggcggagggaccagattgaccgtcctaagtctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacacgtccaattggtgcagtctggaggtggggtgaagaagattggggccgctgtgaggatctcctgcgaggtgactggatataaattcatggaccaactcataaactgggtgcggcaggcccccggtcagggccttgagtggatgggatggatgaatccaacatatggacaagtaaattattcatggagatttgaaggaagggtcaccatgaccagggacatggacaccgagacggccttcatggagttgagaggactgagagtggacgacacggccgtctattattgcgcgaggggaccctctggggaaaattatccttttcactattggggccagggtgtccgagtggtcgtctcgtcacccacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 8804 - DNA, 2139 bp, Artificial Sequence
  Synthetic Polynucleotide encoding a CAR with optional accessory module(s)
atggccttaccagtgaccgccttgctcctgccgctggccttgctgctccacgccgccaggccgctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggcatctgccctgactcagcctgcctccatgtctgcgtcccctggacagtcggtaaccatctcgtgctctggaaccagacacataatctctgcttggttccaacaatatccaggcaaaccacccaaactcataatttttgacgacgataagcgtccctctggagttcctagtcgcttctctgcctccaggcctggcgacacggcctccctgacaatctctaatgttcaacctgaggacgaggcgacgtacatttgcaatacatatgaattctttggcggagggaccagattgaccgtcctaagtggcggaggcggaagtggaggcggaggatctggcggcggaggctctcacgtccaattggtgcagtctggaggtggggtgaagaagattggggccgctgtgaggatctcctgcgaggtgactggatataaattcatggaccaactcataaactgggtgcggcaggcccccggtcagggccttgagtggatgggatggatgaatccaacatatggacaagtaaattattcatggagatttgaaggaagggtcaccatgaccagggacatggacaccgagacggccttcatggagttgagaggactgagagtggacgacacggccgtctattattgcgcgaggggaccctctggggaaaattatccttttcactattggggccagggtgtccgagtggtcgtctcgtcacccacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 8805 - DNA, 1956 bp, Artificial Sequence
  Synthetic Polynucleotide encoding a CAR with optional accessory module(s)
atggccttaccagtgaccgccttgctcctgccgctggccttgctgctccacgccgccaggccggcatctgccctgactcagcctgcctccatgtctgcgtcccctggacagtcggtaaccatctcgtgctctggaaccagacacataatctctgcttggttccaacaatatccaggcaaaccacccaaactcataatttttgacgacgataagcgtccctctggagttcctagtcgcttctctgcctccaggcctggcgacacggcctccctgacaatctctaatgttcaacctgaggacgaggcgacgtacatttgcaatacatatgaattctttggcggagggaccagattgaccgtcctaagtctcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacacgtccaattggtgcagtctggaggtggggtgaagaagattggggccgctgtgaggatctcctgcgaggtgactggatataaattcatggaccaactcataaactgggtgcggcaggcccccggtcagggccttgagtggatgggatggatgaatccaacatatggacaagtaaattattcatggagatttgaaggaagggtcaccatgaccagggacatggacaccgagacggccttcatggagttgagaggactgagagtggacgacacggccgtctattattgcgcgaggggaccctctggggaaaattatccttttcactattggggccagggtgtccgagtggtcgtctcgtcacccacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctc

SEQ ID NO: 8806 - DNA, 1512 bp, Artificial Sequence
  Synthetic Polynucleotide encoding a CAR with optional accessory module(s)
atggccttaccagtgaccgccttgctcctgccgctggccttgctgctccacgccgccaggccgcagtgtgtgctgacccagcctagatccgtgtctggctctcctggacagagcgtgaccatcagctgtaccggcacacacaactacgtgtcctggtgccagcaccatcctggcaatgcccctaagctgctgctgtacgacttcgacaaacggcccagcggcatcagcgatagattcagcggaagcagaagcggcaacaccgccagcctgacaatctctggactccagcctgaggacgaggccgactacttctgctgggcctttgaagcctttggcggaggcacaaaggtgctggttcttagaggcggaggcggaagtggaggcggaggatctggcggcggaggctcttctgctgaactggttcagtctggggccgtcgtgaagaaacctggcacctctgtgaaggtgtcctgccaggcttacggctacacctttaccgactacctgatccactggctgagacaggcccctggacaaggactggaatggatgggctggatgaaccccgtgtacggccaagtgaactacgcccagaacttccagggcagagtgtccatgaccagagacatctacagagagacagccttcctggaagtgcgggacctgaaaaccgatgacaccggcacctactactgcgtcagagatacaggcgacggcagcagaaggcacttcgacagcatcaactggtttctggacctgtggggcagaggcacctggattagagttgctcctgctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 8807 - DNA, 1515 bp, Artificial Sequence
  Synthetic Polynucleotide encoding a CAR with optional accessory module(s)
atggccttaccagtgaccgccttgctcctgccgctggccttgctgctccacgccgccaggccgtctgctgaactggttcagtctggggccgtcgtgaagaaacctggcacctctgtgaaggtgtcctgccaggcttacggctacacctttaccgactacctgatccactggctgagacaggcccctggacaaggactggaatggatgggctggatgaaccccgtgtacggccaagtgaactacgcccagaacttccagggcagagtgtccatgaccagagacatctacagagagacagccttcctggaagtgcgggacctgaaaaccgatgacaccggcacctactactgcgtcagagatacaggcgacggcagcagaaggcacttcgacagcatcaactggtttctggacctgtggggcagaggcacctggattagagttgctcctgctggcggaggcggaagtggaggcggaggatctggcggcggaggctcttgacagtgtgtgctgacccagcctagatccgtgtctggctctcctggacagagcgtgaccatcagctgtaccggcacacacaactacgtgtcctggtgccagcaccatcctggcaatgcccctaagctgctgctgtacgacttcgacaaacggcccagcggcatcagcgatagattcagcggaagcagaagcggcaacaccgccagcctgacaatctctggactccagcctgaggacgaggccgactacttctgctgggcctttgaagcctttggcggaggcacaaaggtgctggttcttagaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 8808 - DNA, 2040 bp, Artificial Sequence
  Synthetic Polynucleotide encoding a CAR with optional accessory module(s)
atggccttaccagtgaccgccttgctcctgccgctggccttgctgctccacgccgccaggccgcagtgtgtgctgacccagcctagatccgtgtctggctctcctggacagagcgtgaccatcagctgtaccggcacacacaactacgtgtcctggtgccagcaccatcctggcaatgcccctaagctgctgctgtacgacttcgacaaacggcccagcggcatcagcgatagattcagcggaagcagaagcggcaacaccgccagcctgacaatctctggactccagcctgaggacgaggccgactacttctgctgggcctttgaagcctttggcggaggcacaaaggtgctggttcttagaggcggaggcggaagtggaggcggaggatctggcggcggaggctcttctgctgaactggttcagtctggggccgtcgtgaagaaacctggcacctctgtgaaggtgtcctgccaggcttacggctacacctttaccgactacctgatccactggctgagacaggcccctggacaaggactggaatggatgggctggatgaaccccgtgtacggccaagtgaactacgcccagaacttccagggcagagtgtccatgaccagagacatctacagagagacagccttcctggaagtgcgggacctgaaaaccgatgacaccggcacctactactgcgtcagagatacaggcgacggcagcagaaggcacttcgacagcatcaactggtttctggacctgtggggcagaggcacctggattagagttgctcctgctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccatga

SEQ ID NO: 8809 - DNA, 2733 bp, Artificial Sequence
  Synthetic Polynucleotide encoding a CAR with optional accessory module(s)
atggccttaccagtgaccgccttgctcctgccgctggccttgctgctccacgccgccaggccgcagtgtgtgctgacccagcctagatccgtgtctggctctcctggacagagcgtgaccatcagctgtaccggcacacacaactacgtgtcctggtgccagcaccatcctggcaatgcccctaagctgctgctgtacgacttcgacaaacggcccagcggcatcagcgatagattcagcggaagcagaagcggcaacaccgccagcctgacaatctctggactccagcctgaggacgaggccgactacttctgctgggcctttgaagcctttggcggaggcacaaaggtgctggttcttagaggcggaggcggaagtggaggcggaggatctggcggcggaggctcttctgctgaactggttcagtctggggccgtcgtgaagaaacctggcacctctgtgaaggtgtcctgccaggcttacggctacacctttaccgactacctgatccactggctgagacaggcccctggacaaggactggaatggatgggctggatgaaccccgtgtacggccaagtgaactacgcccagaacttccagggcagagtgtccatgaccagagacatctacagagagacagccttcctggaagtgcgggacctgaaaaccgatgacaccggcacctactactgcgtcagagatacaggcgacggcagcagaaggcacttcgacagcatcaactggtttctggacctgtggggcagaggcacctggattagagttgctcctgctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8810 - DNA, 2697 bp, Artificial Sequence
  Synthetic Polynucleotide encoding a CAR with optional accessory module(s)
atggccttaccagtgaccgccttgctcctgccgctggccttgctgctccacgccgccaggccgcagtgtgtgctgacccagcctagatccgtgtctggctctcctggacagagcgtgaccatcagctgtaccggcacacacaactacgtgtcctggtgccagcaccatcctggcaatgcccctaagctgctgctgtacgacttcgacaaacggcccagcggcatcagcgatagattcagcggaagcagaagcggcaacaccgccagcctgacaatctctggactccagcctgaggacgaggccgactacttctgctgggcctttgaagcctttggcggaggcacaaaggtgctggttcttagaggcggaggcggaagtggaggcggaggatctggcggcggaggctcttctgctgaactggttcagtctggggccgtcgtgaagaaacctggcacctctgtgaaggtgtcctgccaggcttacggctacacctttaccgactacctgatccactggctgagacaggcccctggacaaggactggaatggatgggctggatgaaccccgtgtacggccaagtgaactacgcccagaacttccagggcagagtgtccatgaccagagacatctacagagagacagccttcctggaagtgcgggacctgaaaaccgatgacaccggcacctactactgcgtcagagatacaggcgacggcagcagaaggcacttcgacagcatcaactggtttctggacctgtggggcagaggcacctggattagagttgctcctgctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8811 - DNA, 2592 bp, Artificial Sequence
  Synthetic Polynucleotide encoding a CAR with optional accessory module(s)
atggccttaccagtgaccgccttgctcctgccgctggccttgctgctccacgccgccaggccgcagtgtgtgctgacccagcctagatccgtgtctggctctcctggacagagcgtgaccatcagctgtaccggcacacacaactacgtgtcctggtgccagcaccatcctggcaatgcccctaagctgctgctgtacgacttcgacaaacggcccagcggcatcagcgatagattcagcggaagcagaagcggcaacaccgccagcctgacaatctctggactccagcctgaggacgaggccgactacttctgctgggcctttgaagcctttggcggaggcacaaaggtgctggttcttagaggcggaggcggaagtggaggcggaggatctggcggcggaggctcttctgctgaactggttcagtctggggccgtcgtgaagaaacctggcacctctgtgaaggtgtcctgccaggcttacggctacacctttaccgactacctgatccactggctgagacaggcccctggacaaggactggaatggatgggctggatgaaccccgtgtacggccaagtgaactacgcccagaacttccagggcagagtgtccatgaccagagacatctacagagagacagccttcctggaagtgcgggacctgaaaaccgatgacaccggcacctactactgcgtcagagatacaggcgacggcagcagaaggcacttcgacagcatcaactggtttctggacctgtggggcagaggcacctggattagagttgctcctgctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8812 - DNA, 2622 bp, Artificial Sequence
  Synthetic Polynucleotide encoding a CAR with optional accessory module(s)
atggccttaccagtgaccgccttgctcctgccgctggccttgctgctccacgccgccaggccgcagtgtgtgctgacccagcctagatccgtgtctggctctcctggacagagcgtgaccatcagctgtaccggcacacacaactacgtgtcctggtgccagcaccatcctggcaatgcccctaagctgctgctgtacgacttcgacaaacggcccagcggcatcagcgatagattcagcggaagcagaagcggcaacaccgccagcctgacaatctctggactccagcctgaggacgaggccgactacttctgctgggcctttgaagcctttggcggaggcacaaaggtgctggttcttagaggcggaggcggaagtggaggcggaggatctggcggcggaggctcttctgctgaactggttcagtctggggccgtcgtgaagaaacctggcacctctgtgaaggtgtcctgccaggcttacggctacacctttaccgactacctgatccactggctgagacaggcccctggacaaggactggaatggatgggctggatgaaccccgtgtacggccaagtgaactacgcccagaacttccagggcagagtgtccatgaccagagacatctacagagagacagccttcctggaagtgcgggacctgaaaaccgatgacaccggcacctactactgcgtcagagatacaggcgacggcagcagaaggcacttcgacagcatcaactggtttctggacctgtggggcagaggcacctggattagagttgctcctgctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8813 - DNA, 2571 bp, Artificial Sequence
  Synthetic Polynucleotide encoding a CAR with optional accessory module(s)
atggccttaccagtgaccgccttgctcctgccgctggccttgctgctccacgccgccaggccgcagtgtgtgctgacccagcctagatccgtgtctggctctcctggacagagcgtgaccatcagctgtaccggcacacacaactacgtgtcctggtgccagcaccatcctggcaatgcccctaagctgctgctgtacgacttcgacaaacggcccagcggcatcagcgatagattcagcggaagcagaagcggcaacaccgccagcctgacaatctctggactccagcctgaggacgaggccgactacttctgctgggcctttgaagcctttggcggaggcacaaaggtgctggttcttagaggcggaggcggaagtggaggcggaggatctggcggcggaggctcttctgctgaactggttcagtctggggccgtcgtgaagaaacctggcacctctgtgaaggtgtcctgccaggcttacggctacacctttaccgactacctgatccactggctgagacaggcccctggacaaggactggaatggatgggctggatgaaccccgtgtacggccaagtgaactacgcccagaacttccagggcagagtgtccatgaccagagacatctacagagagacagccttcctggaagtgcgggacctgaaaaccgatgacaccggcacctactactgcgtcagagatacaggcgacggcagcagaaggcacttcgacagcatcaactggtttctggacctgtggggcagaggcacctggattagagttgctcctgctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8814 - DNA, 2547 bp, Artificial Sequence
  Synthetic Polynucleotide encoding a CAR with optional accessory module(s)
atggccttaccagtgaccgccttgctcctgccgctggccttgctgctccacgccgccaggccgtctgctgaactggttcagtctggggccgtcgtgaagaaacctggcacctctgtgaaggtgtcctgccaggcttacggctacacctttaccgactacctgatccactggctgagacaggcccctggacaaggactggaatggatgggctggatgaaccccgtgtacggccaagtgaactacgcccagaacttccagggcagagtgtccatgaccagagacatctacagagagacagccttcctggaagtgcgggacctgaaaaccgatgacaccggcacctactactgcgtcagagatacaggcgacggcagcagaaggcacttcgacagcatcaactggtttctggacctgtggggcagaggcacctggattagagttgctcctgctggcggaggcggaagtggaggcggaggatctggcggcggaggctcttgacagtgtgtgctgacccagcctagatccgtgtctggctctcctggacagagcgtgaccatcagctgtaccggcacacacaactacgtgtcctggtgccagcaccatcctggcaatgcccctaagctgctgctgtacgacttcgacaaacggcccagcggcatcagcgatagattcagcggaagcagaagcggcaacaccgccagcctgacaatctctggactccagcctgaggacgaggccgactacttctgctgggcctttgaagcctttggcggaggcacaaaggtgctggttcttagaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccc

SEQ ID NO: 8815 - DNA, 2595 bp, Artificial Sequence
  Synthetic Polynucleotide encoding a CAR with optional accessory module(s)
atggccttaccagtgaccgccttgctcctgccgctggccttgctgctccacgccgccaggccgtctgctgaactggttcagtctggggccgtcgtgaagaaacctggcacctctgtgaaggtgtcctgccaggcttacggctacacctttaccgactacctgatccactggctgagacaggcccctggacaaggactggaatggatgggctggatgaaccccgtgtacggccaagtgaactacgcccagaacttccagggcagagtgtccatgaccagagacatctacagagagacagccttcctggaagtgcgggacctgaaaaccgatgacaccggcacctactactgcgtcagagatacaggcgacggcagcagaaggcacttcgacagcatcaactggtttctggacctgtggggcagaggcacctggattagagttgctcctgctggcggaggcggaagtggaggcggaggatctggcggcggaggctcttgacagtgtgtgctgacccagcctagatccgtgtctggctctcctggacagagcgtgaccatcagctgtaccggcacacacaactacgtgtcctggtgccagcaccatcctggcaatgcccctaagctgctgctgtacgacttcgacaaacggcccagcggcatcagcgatagattcagcggaagcagaagcggcaacaccgccagcctgacaatctctggactccagcctgaggacgaggccgactacttctgctgggcctttgaagcctttggcggaggcacaaaggtgctggttcttagaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8816 - DNA, 2625 bp, Artificial Sequence
  Synthetic Polynucleotide encoding a CAR with optional accessory module(s)
atggccttaccagtgaccgccttgctcctgccgctggccttgctgctccacgccgccaggccgtctgctgaactggttcagtctggggccgtcgtgaagaaacctggcacctctgtgaaggtgtcctgccaggcttacggctacacctttaccgactacctgatccactggctgagacaggcccctggacaaggactggaatggatgggctggatgaaccccgtgtacggccaagtgaactacgcccagaacttccagggcagagtgtccatgaccagagacatctacagagagacagccttcctggaagtgcgggacctgaaaaccgatgacaccggcacctactactgcgtcagagatacaggcgacggcagcagaaggcacttcgacagcatcaactggtttctggacctgtggggcagaggcacctggattagagttgctcctgctggcggaggcggaagtggaggcggaggatctggcggcggaggctcttgacagtgtgtgctgacccagcctagatccgtgtctggctctcctggacagagcgtgaccatcagctgtaccggcacacacaactacgtgtcctggtgccagcaccatcctggcaatgcccctaagctgctgctgtacgacttcgacaaacggcccagcggcatcagcgatagattcagcggaagcagaagcggcaacaccgccagcctgacaatctctggactccagcctgaggacgaggccgactacttctgctgggcctttgaagcctttggcggaggcacaaaggtgctggttcttagaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8817 - DNA, 2574 bp, Artificial Sequence
  Synthetic Polynucleotide encoding a CAR with optional accessory module(s)
atggccttaccagtgaccgccttgctcctgccgctggccttgctgctccacgccgccaggccgtctgctgaactggttcagtctggggccgtcgtgaagaaacctggcacctctgtgaaggtgtcctgccaggcttacggctacacctttaccgactacctgatccactggctgagacaggcccctggacaaggactggaatggatgggctggatgaaccccgtgtacggccaagtgaactacgcccagaacttccagggcagagtgtccatgaccagagacatctacagagagacagccttcctggaagtgcgggacctgaaaaccgatgacaccggcacctactactgcgtcagagatacaggcgacggcagcagaaggcacttcgacagcatcaactggtttctggacctgtggggcagaggcacctggattagagttgctcctgctggcggaggcggaagtggaggcggaggatctggcggcggaggctcttgacagtgtgtgctgacccagcctagatccgtgtctggctctcctggacagagcgtgaccatcagctgtaccggcacacacaactacgtgtcctggtgccagcaccatcctggcaatgcccctaagctgctgctgtacgacttcgacaaacggcccagcggcatcagcgatagattcagcggaagcagaagcggcaacaccgccagcctgacaatctctggactccagcctgaggacgaggccgactacttctgctgggcctttgaagcctttggcggaggcacaaaggtgctggttcttagaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8818 - DNA, 1866 bp, Artificial Sequence
  Synthetic Polynucleotide encoding a CAR with optional accessory module(s)
atggccttaccagtgaccgccttgctcctgccgctggccttgctgctccacgccgccaggccgcagtgtgtgctgacccagcctagatccgtgtctggctctcctggacagagcgtgaccatcagctgtaccggcacacacaactacgtgtcctggtgccagcaccatcctggcaatgcccctaagctgctgctgtacgacttcgacaaacggcccagcggcatcagcgatagattcagcggaagcagaagcggcaacaccgccagcctgacaatctctggactccagcctgaggacgaggccgactacttctgctgggcctttgaagcctttggcggaggcacaaaggtgctggttcttagactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaatctgctgaactggttcagtctggggccgtcgtgaagaaacctggcacctctgtgaaggtgtcctgccaggcttacggctacacctttaccgactacctgatccactggctgagacaggcccctggacaaggactggaatggatgggctggatgaaccccgtgtacggccaagtgaactacgcccagaacttccagggcagagtgtccatgaccagagacatctacagagagacagccttcctggaagtgcgggacctgaaaaccgatgacaccggcacctactactgcgtcagagatacaggcgacggcagcagaaggcacttcgacagcatcaactggtttctggacctgtggggcagaggcacctggattagagttgctcctgctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 8819 - DNA, 1881 bp, Artificial Sequence
  Synthetic Polynucleotide encoding a CAR with optional accessory module(s)
atggccttaccagtgaccgccttgctcctgccgctggccttgctgctccacgccgccaggccgcagtgtgtgctgacccagcctagatccgtgtctggctctcctggacagagcgtgaccatcagctgtaccggcacacacaactacgtgtcctggtgccagcaccatcctggcaatgcccctaagctgctgctgtacgacttcgacaaacggcccagcggcatcagcgatagattcagcggaagcagaagcggcaacaccgccagcctgacaatctctggactccagcctgaggacgaggccgactacttctgctgggcctttgaagcctttggcggaggcacaaaggtgctggttcttagactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaatctgctgaactggttcagtctggggccgtcgtgaagaaacctggcacctctgtgaaggtgtcctgccaggcttacggctacacctttaccgactacctgatccactggctgagacaggcccctggacaaggactggaatggatgggctggatgaaccccgtgtacggccaagtgaactacgcccagaacttccagggcagagtgtccatgaccagagacatctacagagagacagccttcctggaagtgcgggacctgaaaaccgatgacaccggcacctactactgcgtcagagatacaggcgacggcagcagaaggcacttcgacagcatcaactggtttctggacctgtggggcagaggcacctggattagagttgctcctgctacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 8820 - DNA, 1911 bp, Artificial Sequence
  Synthetic Polynucleotide encoding a CAR with optional accessory module(s)
atggccttaccagtgaccgccttgctcctgccgctggccttgctgctccacgccgccaggccgcagtgtgtgctgacccagcctagatccgtgtctggctctcctggacagagcgtgaccatcagctgtaccggcacacacaactacgtgtcctggtgccagcaccatcctggcaatgcccctaagctgctgctgtacgacttcgacaaacggcccagcggcatcagcgatagattcagcggaagcagaagcggcaacaccgccagcctgacaatctctggactccagcctgaggacgaggccgactacttctgctgggcctttgaagcctttggcggaggcacaaaggtgctggttcttagactcgagcctggtggcggaggatctcctgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaatctgctgaactggttcagtctggggccgtcgtgaagaaacctggcacctctgtgaaggtgtcctgccaggcttacggctacacctttaccgactacctgatccactggctgagacaggcccctggacaaggactggaatggatgggctggatgaaccccgtgtacggccaagtgaactacgcccagaacttccagggcagagtgtccatgaccagagacatctacagagagacagccttcctggaagtgcgggacctgaaaaccgatgacaccggcacctactactgcgtcagagatacaggcgacggcagcagaaggcacttcgacagcatcaactggtttctggacctgtggggcagaggcacctggattagagttgctcctgctacgcgtcctggcggaggcgggtctcctatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 8821 - DNA, 1908 bp, Artificial Sequence
  Synthetic Polynucleotide encoding a CAR with optional accessory module(s)
atggccttaccagtgaccgccttgctcctgccgctggccttgctgctccacgccgccaggccgcagtgtgtgctgacccagcctagatccgtgtctggctctcctggacagagcgtgaccatcagctgtaccggcacacacaactacgtgtcctggtgccagcaccatcctggcaatgcccctaagctgctgctgtacgacttcgacaaacggcccagcggcatcagcgatagattcagcggaagcagaagcggcaacaccgccagcctgacaatctctggactccagcctgaggacgaggccgactacttctgctgggcctttgaagcctttggcggaggcacaaaggtgctggttcttagactcgaggttgcggcgctcgaaagggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaatctgctgaactggttcagtctggggccgtcgtgaagaaacctggcacctctgtgaaggtgtcctgccaggcttacggctacacctttaccgactacctgatccactggctgagacaggcccctggacaaggactggaatggatgggctggatgaaccccgtgtacggccaagtgaactacgcccagaacttccagggcagagtgtccatgaccagagacatctacagagagacagccttcctggaagtgcgggacctgaaaaccgatgacaccggcacctactactgcgtcagagatacaggcgacggcagcagaaggcacttcgacagcatcaactggtttctggacctgtggggcagaggcacctggattagagttgctcctgctacgcgtcgtgtggctgcgctcaaggagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 8822 - DNA, 1896 bp, Artificial Sequence
  Synthetic Polynucleotide encoding a CAR with optional accessory module(s)
atggccttaccagtgaccgccttgctcctgccgctggccttgctgctccacgccgccaggccgcagtgtgtgctgacccagcctagatccgtgtctggctctcctggacagagcgtgaccatcagctgtaccggcacacacaactacgtgtcctggtgccagcaccatcctggcaatgcccctaagctgctgctgtacgacttcgacaaacggcccagcggcatcagcgatagattcagcggaagcagaagcggcaacaccgccagcctgacaatctctggactccagcctgaggacgaggccgactacttctgctgggcctttgaagcctttggcggaggcacaaaggtgctggttcttagactcgaggccgcagcaaaggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaatctgctgaactggttcagtctggggccgtcgtgaagaaacctggcacctctgtgaaggtgtcctgccaggcttacggctacacctttaccgactacctgatccactggctgagacaggcccctggacaaggactggaatggatgggctggatgaaccccgtgtacggccaagtgaactacgcccagaacttccagggcagagtgtccatgaccagagacatctacagagagacagccttcctggaagtgcgggacctgaaaaccgatgacaccggcacctactactgcgtcagagatacaggcgacggcagcagaaggcacttcgacagcatcaactggtttctggacctgtggggcagaggcacctggattagagttgctcctgctacgcgtgaagcagccgccaagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 8823 - DNA, 1959 bp, Artificial Sequence
  Synthetic Polynucleotide encoding a CAR with optional accessory module(s)
atggccttaccagtgaccgccttgctcctgccgctggccttgctgctccacgccgccaggccgcagtgtgtgctgacccagcctagatccgtgtctggctctcctggacagagcgtgaccatcagctgtaccggcacacacaactacgtgtcctggtgccagcaccatcctggcaatgcccctaagctgctgctgtacgacttcgacaaacggcccagcggcatcagcgatagattcagcggaagcagaagcggcaacaccgccagcctgacaatctctggactccagcctgaggacgaggccgactacttctgctgggcctttgaagcctttggcggaggcacaaaggtgctggttcttagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaatctgctgaactggttcagtctggggccgtcgtgaagaaacctggcacctctgtgaaggtgtcctgccaggcttacggctacacctttaccgactacctgatccactggctgagacaggcccctggacaaggactggaatggatgggctggatgaaccccgtgtacggccaagtgaactacgcccagaacttccagggcagagtgtccatgaccagagacatctacagagagacagccttcctggaagtgcgggacctgaaaaccgatgacaccggcacctactactgcgtcagagatacaggcgacggcagcagaaggcacttcgacagcatcaactggtttctggacctgtggggcagaggcacctggattagagttgctcctgctacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 8824 - DNA, 3228 bp, Artificial Sequence
  Synthetic Polynucleotide encoding a CAR with optional accessory module(s)
atggccttaccagtgaccgccttgctcctgccgctggccttgctgctccacgccgccaggccgcagtgtgtgctgacccagcctagatccgtgtctggctctcctggacagagcgtgaccatcagctgtaccggcacacacaactacgtgtcctggtgccagcaccatcctggcaatgcccctaagctgctgctgtacgacttcgacaaacggcccagcggcatcagcgatagattcagcggaagcagaagcggcaacaccgccagcctgacaatctctggactccagcctgaggacgaggccgactacttctgctgggcctttgaagcctttggcggaggcacaaaggtgctggttcttagactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaatctgctgaactggttcagtctggggccgtcgtgaagaaacctggcacctctgtgaaggtgtcctgccaggcttacggctacacctttaccgactacctgatccactggctgagacaggcccctggacaaggactggaatggatgggctggatgaaccccgtgtacggccaagtgaactacgcccagaacttccagggcagagtgtccatgaccagagacatctacagagagacagccttcctggaagtgcgggacctgaaaaccgatgacaccggcacctactactgcgtcagagatacaggcgacggcagcagaaggcacttcgacagcatcaactggtttctggacctgtggggcagaggcacctggattagagttgctcctgctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8825 - DNA, 3231 bp, Artificial Sequence
  Synthetic Polynucleotide encoding a CAR with optional accessory module(s)
atggccttaccagtgaccgccttgctcctgccgctggccttgctgctccacgccgccaggccgcagtgtgtgctgacccagcctagatccgtgtctggctctcctggacagagcgtgaccatcagctgtaccggcacacacaactacgtgtcctggtgccagcaccatcctggcaatgcccctaagctgctgctgtacgacttcgacaaacggcccagcggcatcagcgatagattcagcggaagcagaagcggcaacaccgccagcctgacaatctctggactccagcctgaggacgaggccgactacttctgctgggcctttgaagcctttggcggaggcacaaaggtgctggttcttagactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaatctgctgaactggttcagtctggggccgtcgtgaagaaacctggcacctctgtgaaggtgtcctgccaggcttacggctacacctttaccgactacctgatccactggctgagacaggcccctggacaaggactggaatggatgggctggatgaaccccgtgtacggccaagtgaactacgcccagaacttccagggcagagtgtccatgaccagagacatctacagagagacagccttcctggaagtgcgggacctgaaaaccgatgacaccggcacctactactgcgtcagagatacaggcgacggcagcagaaggcacttcgacagcatcaactggtttctggacctgtggggcagaggcacctggattagagttgctcctgctacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8826 - DNA, 3390 bp, Artificial Sequence
  Synthetic Polynucleotide encoding a CAR with optional accessory module(s)
atggccttaccagtgaccgccttgctcctgccgctggccttgctgctccacgccgccaggccgcagtgtgtgctgacccagcctagatccgtgtctggctctcctggacagagcgtgaccatcagctgtaccggcacacacaactacgtgtcctggtgccagcaccatcctggcaatgcccctaagctgctgctgtacgacttcgacaaacggcccagcggcatcagcgatagattcagcggaagcagaagcggcaacaccgccagcctgacaatctctggactccagcctgaggacgaggccgactacttctgctgggcctttgaagcctttggcggaggcacaaaggtgctggttcttagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaatctgctgaactggttcagtctggggccgtcgtgaagaaacctggcacctctgtgaaggtgtcctgccaggcttacggctacacctttaccgactacctgatccactggctgagacaggcccctggacaaggactggaatggatgggctggatgaaccccgtgtacggccaagtgaactacgcccagaacttccagggcagagtgtccatgaccagagacatctacagagagacagccttcctggaagtgcgggacctgaaaaccgatgacaccggcacctactactgcgtcagagatacaggcgacggcagcagaaggcacttcgacagcatcaactggtttctggacctgtggggcagaggcacctggattagagttgctcctgctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 8827 - DNA, 3240 bp, Artificial Sequence
  Synthetic Polynucleotide encoding a CAR with optional accessory module(s)
atggccttaccagtgaccgccttgctcctgccgctggccttgctgctccacgccgccaggccgcagtgtgtgctgacccagcctagatccgtgtctggctctcctggacagagcgtgaccatcagctgtaccggcacacacaactacgtgtcctggtgccagcaccatcctggcaatgcccctaagctgctgctgtacgacttcgacaaacggcccagcggcatcagcgatagattcagcggaagcagaagcggcaacaccgccagcctgacaatctctggactccagcctgaggacgaggccgactacttctgctgggcctttgaagcctttggcggaggcacaaaggtgctggttcttagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaatctgctgaactggttcagtctggggccgtcgtgaagaaacctggcacctctgtgaaggtgtcctgccaggcttacggctacacctttaccgactacctgatccactggctgagacaggcccctggacaaggactggaatggatgggctggatgaaccccgtgtacggccaagtgaactacgcccagaacttccagggcagagtgtccatgaccagagacatctacagagagacagccttcctggaagtgcgggacctgaaaaccgatgacaccggcacctactactgcgtcagagatacaggcgacggcagcagaaggcacttcgacagcatcaactggtttctggacctgtggggcagaggcacctggattagagttgctcctgctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8828 - DNA, 3228 bp, Artificial Sequence
  Synthetic Polynucleotide encoding a CAR with optional accessory module(s)
atggccttaccagtgaccgccttgctcctgccgctggccttgctgctccacgccgccaggccgcagtgtgtgctgacccagcctagatccgtgtctggctctcctggacagagcgtgaccatcagctgtaccggcacacacaactacgtgtcctggtgccagcaccatcctggcaatgcccctaagctgctgctgtacgacttcgacaaacggcccagcggcatcagcgatagattcagcggaagcagaagcggcaacaccgccagcctgacaatctctggactccagcctgaggacgaggccgactacttctgctgggcctttgaagcctttggcggaggcacaaaggtgctggttcttagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaatctgctgaactggttcagtctggggccgtcgtgaagaaacctggcacctctgtgaaggtgtcctgccaggcttacggctacacctttaccgactacctgatccactggctgagacaggcccctggacaaggactggaatggatgggctggatgaaccccgtgtacggccaagtgaactacgcccagaacttccagggcagagtgtccatgaccagagacatctacagagagacagccttcctggaagtgcgggacctgaaaaccgatgacaccggcacctactactgcgtcagagatacaggcgacggcagcagaaggcacttcgacagcatcaactggtttctggacctgtggggcagaggcacctggattagagttgctcctgctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggacgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8829 - DNA, 2679 bp, Artificial Sequence
  Synthetic Polynucleotide encoding a CAR with optional accessory module(s)
atggccttaccagtgaccgccttgctcctgccgctggccttgctgctccacgccgccaggccgcagtgtgtgctgacccagcctagatccgtgtctggctctcctggacagagcgtgaccatcagctgtaccggcacacacaactacgtgtcctggtgccagcaccatcctggcaatgcccctaagctgctgctgtacgacttcgacaaacggcccagcggcatcagcgatagattcagcggaagcagaagcggcaacaccgccagcctgacaatctctggactccagcctgaggacgaggccgactacttctgctgggcctttgaagcctttggcggaggcacaaaggtgctggttcttagaggcggaggcggaagtggaggcggaggatctggcggcggaggctcttctgctgaactggttcagtctggggccgtcgtgaagaaacctggcacctctgtgaaggtgtcctgccaggcttacggctacacctttaccgactacctgatccactggctgagacaggcccctggacaaggactggaatggatgggctggatgaaccccgtgtacggccaagtgaactacgcccagaacttccagggcagagtgtccatgaccagagacatctacagagagacagccttcctggaagtgcgggacctgaaaaccgatgacaccggcacctactactgcgtcagagatacaggcgacggcagcagaaggcacttcgacagcatcaactggtttctggacctgtggggcagaggcacctggattagagttgctcctgctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 8830 - DNA, 3711 bp, Artificial Sequence
  Synthetic Polynucleotide encoding a CAR with optional accessory module(s)
atggccttaccagtgaccgccttgctcctgccgctggccttgctgctccacgccgccaggccgcagtgtgtgctgacccagcctagatccgtgtctggctctcctggacagagcgtgaccatcagctgtaccggcacacacaactacgtgtcctggtgccagcaccatcctggcaatgcccctaagctgctgctgtacgacttcgacaaacggcccagcggcatcagcgatagattcagcggaagcagaagcggcaacaccgccagcctgacaatctctggactccagcctgaggacgaggccgactacttctgctgggcctttgaagcctttggcggaggcacaaaggtgctggttcttagaggcggaggcggaagtggaggcggaggatctggcggcggaggctcttctgctgaactggttcagtctggggccgtcgtgaagaaacctggcacctctgtgaaggtgtcctgccaggcttacggctacacctttaccgactacctgatccactggctgagacaggcccctggacaaggactggaatggatgggctggatgaaccccgtgtacggccaagtgaactacgcccagaacttccagggcagagtgtccatgaccagagacatctacagagagacagccttcctggaagtgcgggacctgaaaaccgatgacaccggcacctactactgcgtcagagatacaggcgacggcagcagaaggcacttcgacagcatcaactggtttctggacctgtggggcagaggcacctggattagagttgctcctgctacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcgagctttgcacagaattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctca

SEQ ID NO: 8831 - DNA, 3231 bp, Artificial Sequence
  Synthetic Polynucleotide encoding a CAR with optional accessory module(s)
atggccttaccagtgaccgccttgctcctgccgctggccttgctgctccacgccgccaggccgcagtgtgtgctgacccagcctagatccgtgtctggctctcctggacagagcgtgaccatcagctgtaccggcacacacaactacgtgtcctggtgccagcaccatcctggcaatgcccctaagctgctgctgtacgacttcgacaaacggcccagcggcatcagcgatagattcagcggaagcagaagcggcaacaccgccagcctgacaatctctggactccagcctgaggacgaggccgactacttctgctgggcctttgaagcctttggcggaggcacaaaggtgctggttcttagactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaatctgctgaactggttcagtctggggccgtcgtgaagaaacctggcacctctgtgaaggtgtcctgccaggcttacggctacacctttaccgactacctgatccactggctgagacaggcccctggacaaggactggaatggatgggctggatgaaccccgtgtacggccaagtgaactacgcccagaacttccagggcagagtgtccatgaccagagacatctacagagagacagccttcctggaagtgcgggacctgaaaaccgatgacaccggcacctactactgcgtcagagatacaggcgacggcagcagaaggcacttcgacagcatcaactggtttctggacctgtggggcagaggcacctggattagagttgctcctgctacgcgtgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8832 - DNA, 4206 bp, Artificial Sequence
  Synthetic Polynucleotide encoding a CAR with optional accessory module(s)
atggccttaccagtgaccgccttgctcctgccgctggccttgctgctccacgccgccaggccgcagtgtgtgctgacccagcctagatccgtgtctggctctcctggacagagcgtgaccatcagctgtaccggcacacacaactacgtgtcctggtgccagcaccatcctggcaatgcccctaagctgctgctgtacgacttcgacaaacggcccagcggcatcagcgatagattcagcggaagcagaagcggcaacaccgccagcctgacaatctctggactccagcctgaggacgaggccgactacttctgctgggcctttgaagcctttggcggaggcacaaaggtgctggttcttagactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaatctgctgaactggttcagtctggggccgtcgtgaagaaacctggcacctctgtgaaggtgtcctgccaggcttacggctacacctttaccgactacctgatccactggctgagacaggcccctggacaaggactggaatggatgggctggatgaaccccgtgtacggccaagtgaactacgcccagaacttccagggcagagtgtccatgaccagagacatctacagagagacagccttcctggaagtgcgggacctgaaaaccgatgacaccggcacctactactgcgtcagagatacaggcgacggcagcagaaggcacttcgacagcatcaactggtttctggacctgtggggcagaggcacctggattagagttgctcctgctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggagcggcccccggggctgcggccgggcgcgggcgggccctgggagatgcgggagcggctgggcaccggcggcttcgggaacgtctgtctgtaccagcatcgggaacttgatctcaaaatagcaattaagtcttgtcgcctagagctaagtaccaaaaacagagaacgatggtgccatgaaatccagattatgaagaagttgaaccatgccaatgttgtaaaggcctgtgatgttcctgaagaattgaatattttgattcatgatgtgcctcttctagcaatggaatactgttctggaggagatctccgaaagctgctcaacaaaccagaaaattgttgtggacttaaagaaagccagatactttctttactaagtgatatagggtctgggattcgatatttgcatgaaaacaaaattatacatcgagatctaaaacctgaaaacatagttcttcaggatgttggtggaaagataatacataaaataattgatctgggatatgccaaagatgttgatcaaggagagctgtgtacagagtttgtgggaacactgcagtatctggccccagagctctttgagaataagccttacacagccactgttgattattggagctttgggaccatggtatttgaatgtattgctggatataggccttttttgcatcatctgcagccatttacctggcatgagaagattaagaagaaggatccaaagtgtatatttgcatgtgaagagatgtcaggagaagttcggtttagtagccatttacctcaaccaaatagcctttgtagtttaatagtagaacccatggaaaactggctacagttgatgttgaattgggaccctcagcagagaggaggacctgttgaccttactttgaagcagccaagatgttttgtattaatggatcacattttgaatttgaagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttagaggctgtgatagctatatggtttatttgtttgataaaagtaaaactgtatatgaagggccatttgcttccagaagtttatctgattgtgtaaattatattgtacaggacagcaaaatacagcttccaattatacagctgcgtaaagtgtgggctgaagcagtgcactatgtgtctggactaaaagaagactatagcaggctctttcagggacaaagggcagcaatgttaagtcttcttagatataatgctaacttaacaaaaatgaagaacactttgatctcagcatcacaacaactgaaagctaaattggagttttttcacaaaagcattcagcttgacttggagagatacagcgagcagatgacgtatgggatatcttcagaaaaaatgctaaaagcatggaaagaaatggaagaaaaggccatccactatgctgaggttggtgtcattggatacctggaggatcagattatgtctttgcatgctgaaatcatggggctacagaagagcccctatggaagacgtcagggagacttgatggaatctctggaacagcgtgccattgatctatataagcagttaaaacacagaccttcagatcactcctacagtgacagcacagagatggtgaaaatcattgtgcacactgtgcagagtcaggaccgtgtgctcaaggagctgtttggtcatttgagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtacacagagttctgcccgctctcttgtaggatccagtctagaaggtgcagtaacccctcagacatcagcatggctgcccccgacttcagcagaacatgatcattctctgtcatgtgtggtaactcctcaagatggggagacttcagcacaaatgatagaagaaaatttgaactgccttggccatttaagcactattattcatgaggcaaatgaggaacagggcaatagtatgatgaatcttgattggagttggttaacagaatga

SEQ ID NO: 8833 - DNA, 3204 bp, Artificial Sequence
  Synthetic Polynucleotide encoding a CAR with optional accessory module(s)
atggccttaccagtgaccgccttgctcctgccgctggccttgctgctccacgccgccaggccgcagtgtgtgctgacccagcctagatccgtgtctggctctcctggacagagcgtgaccatcagctgtaccggcacacacaactacgtgtcctggtgccagcaccatcctggcaatgcccctaagctgctgctgtacgacttcgacaaacggcccagcggcatcagcgatagattcagcggaagcagaagcggcaacaccgccagcctgacaatctctggactccagcctgaggacgaggccgactacttctgctgggcctttgaagcctttggcggaggcacaaaggtgctggttcttagactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaatctgctgaactggttcagtctggggccgtcgtgaagaaacctggcacctctgtgaaggtgtcctgccaggcttacggctacacctttaccgactacctgatccactggctgagacaggcccctggacaaggactggaatggatgggctggatgaaccccgtgtacggccaagtgaactacgcccagaacttccagggcagagtgtccatgaccagagacatctacagagagacagccttcctggaagtgcgggacctgaaaaccgatgacaccggcacctactactgcgtcagagatacaggcgacggcagcagaaggcacttcgacagcatcaactggtttctggacctgtggggcagaggcacctggattagagttgctcctgctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagccgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgag

SEQ ID NO: 8834 - DNA, 2016 bp, Artificial Sequence
  Synthetic Polynucleotide encoding a CAR with optional accessory module(s)
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccgcagtgtgtgctgacccagcctagatccgtgtctggctctcctggacagagcgtgaccatcagctgtaccggcacacacaactacgtgtcctggtgccagcaccatcctggcaatgcccctaagctgctgctgtacgacttcgacaaacggcccagcggcatcagcgatagattcagcggaagcagaagcggcaacaccgccagcctgacaatctctggactccagcctgaggacgaggccgactacttctgctgggcctttgaagcctttggcggaggcacaaaggtgctggttcttagaggcggaggcggaagtggaggcggaggatctggcggcggaggctcttctgctgaactggttcagtctggggccgtcgtgaagaaacctggcacctctgtgaaggtgtcctgccaggcttacggctacacctttaccgactacctgatccactggctgagacaggcccctggacaaggactggaatggatgggctggatgaaccccgtgtacggccaagtgaactacgcccagaacttccagggcagagtgtccatgaccagagacatctacagagagacagccttcctggaagtgcgggacctgaaaaccgatgacaccggcacctactactgcgtcagagatacaggcgacggcagcagaaggcacttcgacagcatcaactggtttctggacctgtggggcagaggcacctggattagagttgctcctgctacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 8835 - DNA, 1956 bp, Artificial Sequence
  Synthetic Polynucleotide encoding a CAR with optional accessory module(s)
atggccttaccagtgaccgccttgctcctgccgctggccttgctgctccacgccgccaggccgcagtgtgtgctgacccagcctagatccgtgtctggctctcctggacagagcgtgaccatcagctgtaccggcacacacaactacgtgtcctggtgccagcaccatcctggcaatgcccctaagctgctgctgtacgacttcgacaaacggcccagcggcatcagcgatagattcagcggaagcagaagcggcaacaccgccagcctgacaatctctggactccagcctgaggacgaggccgactacttctgctgggcctttgaagcctttggcggaggcacaaaggtgctggttcttagactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaatctgctgaactggttcagtctggggccgtcgtgaagaaacctggcacctctgtgaaggtgtcctgccaggcttacggctacacctttaccgactacctgatccactggctgagacaggcccctggacaaggactggaatggatgggctggatgaaccccgtgtacggccaagtgaactacgcccagaacttccagggcagagtgtccatgaccagagacatctacagagagacagccttcctggaagtgcgggacctgaaaaccgatgacaccggcacctactactgcgtcagagatacaggcgacggcagcagaaggcacttcgacagcatcaactggtttctggacctgtggggcagaggcacctggattagagttgctcctgctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 8836 - DNA, 1866 bp, Artificial Sequence
  Synthetic Polynucleotide encoding a CAR with optional accessory module(s)
atggccttaccagtgaccgccttgctcctgccgctggccttgctgctccacgccgccaggccgcagtgtgtgctgacccagcctagatccgtgtctggctctcctggacagagcgtgaccatcagctgtaccggcacacacaactacgtgtcctggtgccagcaccatcctggcaatgcccctaagctgctgctgtacgacttcgacaaacggcccagcggcatcagcgatagattcagcggaagcagaagcggcaacaccgccagcctgacaatctctggactccagcctgaggacgaggccgactacttctgctgggcctttgaagcctttggcggaggcacaaaggtgctggttcttagactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaatctgctgaactggttcagtctggggccgtcgtgaagaaacctggcacctctgtgaaggtgtcctgccaggcttacggctacacctttaccgactacctgatccactggctgagacaggcccctggacaaggactggaatggatgggctggatgaaccccgtgtacggccaagtgaactacgcccagaacttccagggcagagtgtccatgaccagagacatctacagagagacagccttcctggaagtgcgggacctgaaaaccgatgacaccggcacctactactgcgtcagagatacaggcgacggcagcagaaggcacttcgacagcatcaactggtttctggacctgtggggcagaggcacctggattagagttgctcctgctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 8837 - DNA, 2112 bp, Artificial Sequence
  Synthetic Polynucleotide encoding a CAR with optional accessory module(s)
atggccttaccagtgaccgccttgctcctgccgctggccttgctgctccacgccgccaggccgcagtgtgtgctgacccagcctagatccgtgtctggctctcctggacagagcgtgaccatcagctgtaccggcacacacaactacgtgtcctggtgccagcaccatcctggcaatgcccctaagctgctgctgtacgacttcgacaaacggcccagcggcatcagcgatagattcagcggaagcagaagcggcaacaccgccagcctgacaatctctggactccagcctgaggacgaggccgactacttctgctgggcctttgaagcctttggcggaggcacaaaggtgctggttcttagactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaatctgctgaactggttcagtctggggccgtcgtgaagaaacctggcacctctgtgaaggtgtcctgccaggcttacggctacacctttaccgactacctgatccactggctgagacaggcccctggacaaggactggaatggatgggctggatgaaccccgtgtacggccaagtgaactacgcccagaacttccagggcagagtgtccatgaccagagacatctacagagagacagccttcctggaagtgcgggacctgaaaaccgatgacaccggcacctactactgcgtcagagatacaggcgacggcagcagaaggcacttcgacagcatcaactggtttctggacctgtggggcagaggcacctggattagagttgctcctgctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 8838 - DNA, 2160 bp, Artificial Sequence
  Synthetic Polynucleotide encoding a CAR with optional accessory module(s)
atggccttaccagtgaccgccttgctcctgccgctggccttgctgctccacgccgccaggccgctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccgcagtgtgtgctgacccagcctagatccgtgtctggctctcctggacagagcgtgaccatcagctgtaccggcacacacaactacgtgtcctggtgccagcaccatcctggcaatgcccctaagctgctgctgtacgacttcgacaaacggcccagcggcatcagcgatagattcagcggaagcagaagcggcaacaccgccagcctgacaatctctggactccagcctgaggacgaggccgactacttctgctgggcctttgaagcctttggcggaggcacaaaggtgctggttcttagaggcggaggcggaagtggaggcggaggatctggcggcggaggctcttctgctgaactggttcagtctggggccgtcgtgaagaaacctggcacctctgtgaaggtgtcctgccaggcttacggctacacctttaccgactacctgatccactggctgagacaggcccctggacaaggactggaatggatgggctggatgaaccccgtgtacggccaagtgaactacgcccagaacttccagggcagagtgtccatgaccagagacatctacagagagacagccttcctggaagtgcgggacctgaaaaccgatgacaccggcacctactactgcgtcagagatacaggcgacggcagcagaaggcacttcgacagcatcaactggtttctggacctgtggggcagaggcacctggattagagttgctcctgctacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 8839 - DNA, 1977 bp, Artificial Sequence
  Synthetic Polynucleotide encoding a CAR with optional accessory module(s)
atggccttaccagtgaccgccttgctcctgccgctggccttgctgctccacgccgccaggccgcagtgtgtgctgacccagcctagatccgtgtctggctctcctggacagagcgtgaccatcagctgtaccggcacacacaactacgtgtcctggtgccagcaccatcctggcaatgcccctaagctgctgctgtacgacttcgacaaacggcccagcggcatcagcgatagattcagcggaagcagaagcggcaacaccgccagcctgacaatctctggactccagcctgaggacgaggccgactacttctgctgggcctttgaagcctttggcggaggcacaaaggtgctggttcttagactcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaatctgctgaactggttcagtctggggccgtcgtgaagaaacctggcacctctgtgaaggtgtcctgccaggcttacggctacacctttaccgactacctgatccactggctgagacaggcccctggacaaggactggaatggatgggctggatgaaccccgtgtacggccaagtgaactacgcccagaacttccagggcagagtgtccatgaccagagacatctacagagagacagccttcctggaagtgcgggacctgaaaaccgatgacaccggcacctactactgcgtcagagatacaggcgacggcagcagaaggcacttcgacagcatcaactggtttctggacctgtggggcagaggcacctggattagagttgctcctgctacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctc

SEQ ID NO: 8840 - DNA, 1485 bp, Artificial Sequence
  Synthetic Polynucleotide encoding a CAR with optional accessory module(s)
atggccttaccagtgaccgccttgctcctgccgctggccttgctgctccacgccgccaggccgtacgtgcagagccagtctcctagcacactgtacgccagcgtgggcgacaagatcaccatcacctgtagaagcagccagagcggctggaaagcctggtatcagcagaagcctggcaaggcccctaagctgctgatctacaagagcagcatcctggaaaccggcgtgcccagcagattttccggcagcgatagcggcaccgagttcaccctgacaatcagcagcctccagcctgacgacttcgccacctactactgccagcacttcgagacattcggccagggcaccagagtgcaagttcgcggcggaggcggaagtggaggcggaggatctggcggcggaggctctcaaattgagctggtgcagagcggcacagaagtgaagaggccaggcgcttctgtgcggatcagctgtgcctctagcggctacagattcaccaactacttcatccactgggtccgacaggcccctggcagaggacttgaatggatgggctggatgaaccctctgcacggcggcgtgaactacagcggcagatttcagggcagagtgaccatgaccagagacatctacaccgaaaccagcttcatggtgctgtccggcctgacctccgacgacaccgccatctatttctgtaccagaggccgcgacggctacgacgatggatttcatccttggggccagggaaccctggtcacagtttctgctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 8841 - DNA, 1488 bp, Artificial Sequence
  Synthetic Polynucleotide encoding a CAR with optional accessory module(s)
atggccttaccagtgaccgccttgctcctgccgctggccttgctgctccacgccgccaggccgcaaattgagctggtgcagagcggcacagaagtgaagaggccaggcgcttctgtgcggatcagctgtgcctctagcggctacagattcaccaactacttcatccactgggtccgacaggcccctggcagaggacttgaatggatgggctggatgaaccctctgcacggcggcgtgaactacagcggcagatttcagggcagagtgaccatgaccagagacatctacaccgaaaccagcttcatggtgctgtccggcctgacctccgacgacaccgccatctatttctgtaccagaggccgcgacggctacgacgatggatttcatccttggggccagggaaccctggtcacagtttctgctggcggaggcggaagtggaggcggaggatctggcggcggaggctcttgatacgtgcagagccagtctcctagcacactgtacgccagcgtgggcgacaagatcaccatcacctgtagaagcagccagagcggctggaaagcctggtatcagcagaagcctggcaaggcccctaagctgctgatctacaagagcagcatcctggaaaccggcgtgcccagcagattttccggcagcgatagcggcaccgagttcaccctgacaatcagcagcctccagcctgacgacttcgccacctactactgccagcacttcgagacattcggccagggcaccagagtgcaagttcgcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 8842 - DNA, 2013 bp, Artificial Sequence
  Synthetic Polynucleotide encoding a CAR with optional accessory module(s)
atggccttaccagtgaccgccttgctcctgccgctggccttgctgctccacgccgccaggccgtacgtgcagagccagtctcctagcacactgtacgccagcgtgggcgacaagatcaccatcacctgtagaagcagccagagcggctggaaagcctggtatcagcagaagcctggcaaggcccctaagctgctgatctacaagagcagcatcctggaaaccggcgtgcccagcagattttccggcagcgatagcggcaccgagttcaccctgacaatcagcagcctccagcctgacgacttcgccacctactactgccagcacttcgagacattcggccagggcaccagagtgcaagttcgcggcggaggcggaagtggaggcggaggatctggcggcggaggctctcaaattgagctggtgcagagcggcacagaagtgaagaggccaggcgcttctgtgcggatcagctgtgcctctagcggctacagattcaccaactacttcatccactgggtccgacaggcccctggcagaggacttgaatggatgggctggatgaaccctctgcacggcggcgtgaactacagcggcagatttcagggcagagtgaccatgaccagagacatctacaccgaaaccagcttcatggtgctgtccggcctgacctccgacgacaccgccatctatttctgtaccagaggccgcgacggctacgacgatggatttcatccttggggccagggaaccctggtcacagtttctgctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccatga

SEQ ID NO: 8843 - DNA, 2706 bp, Artificial Sequence
  Synthetic Polynucleotide encoding a CAR with optional accessory module(s)
atggccttaccagtgaccgccttgctcctgccgctggccttgctgctccacgccgccaggccgtacgtgcagagccagtctcctagcacactgtacgccagcgtgggcgacaagatcaccatcacctgtagaagcagccagagcggctggaaagcctggtatcagcagaagcctggcaaggcccctaagctgctgatctacaagagcagcatcctggaaaccggcgtgcccagcagattttccggcagcgatagcggcaccgagttcaccctgacaatcagcagcctccagcctgacgacttcgccacctactactgccagcacttcgagacattcggccagggcaccagagtgcaagttcgcggcggaggcggaagtggaggcggaggatctggcggcggaggctctcaaattgagctggtgcagagcggcacagaagtgaagaggccaggcgcttctgtgcggatcagctgtgcctctagcggctacagattcaccaactacttcatccactgggtccgacaggcccctggcagaggacttgaatggatgggctggatgaaccctctgcacggcggcgtgaactacagcggcagatttcagggcagagtgaccatgaccagagacatctacaccgaaaccagcttcatggtgctgtccggcctgacctccgacgacaccgccatctatttctgtaccagaggccgcgacggctacgacgatggatttcatccttggggccagggaaccctggtcacagtttctgctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 8844 - DNA, 2670 bp, Artificial Sequence
  Synthetic Polynucleotide encoding a CAR with optional accessory module(s)
atggccttaccagtgaccgccttgctcctgccgctggccttgctgctccacgccgccaggccgtacgtgcagagccagtctcctagcacactgtacgccagcgtgggcgacaagatcaccatcacctgtagaagcagccagagcggctggaaagcctggtatcagcagaagcctggcaaggcccctaagctgctgatctacaagagcagcatcctggaaaccggcgtgcccagcagattttccggcagcgatagcggcaccgagttcaccctgacaatcagcagcctccagcctgacgacttcgccacctactactgccagcacttcgagacattcggccagggcaccagagtgcaagttcgcggcggaggcggaagtggaggcggaggatctggcggcggaggctctcaaattgagctggtgcagagcggcacagaagtgaagaggccaggcgcttctgtgcggatcagctgtgcctctagcggctacagattcaccaactacttcatccactgggtccgacaggcccctggcagaggacttgaatggatgggctggatgaaccctctgcacggcggcgtgaactacagcggcagatttcagggcagagtgaccatgaccagagacatctacaccgaaaccagcttcatggtgctgtccggcctgacctccgacgacaccgccatctatttctgtaccagaggccgcgacggctacgacgatggatttcatccttggggccagggaaccctggtcacagtttctgctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga
